(12) United States Patent
Brown et al.

(10) Patent No.: US 10,351,854 B2
(45) Date of Patent: Jul. 16, 2019

(54) THERAPEUTIC INHIBITION OF LACTATE DEHYDROGENASE AND AGENTS THEREFOR

(71) Applicant: Dicerna Pharmaceuticals, Inc., Cambridge, MA (US)

(72) Inventors: Bob D. Brown, Littleton, MA (US); Henryk T. Dudek, Wellesley, MA (US); Cheng Lai, Belmont, MA (US)

(73) Assignee: Dicerna Pharmaceuticals, Inc., Cambridge, MA (US)

( * ) Notice: Subject to any disclaimer, the term of this patent is extended or adjusted under 35 U.S.C. 154(b) by 0 days.

(21) Appl. No.: 15/518,009

(22) PCT Filed: Oct. 9, 2015

(86) PCT No.: PCT/US2015/054959
§ 371 (c)(1),
(2) Date: Apr. 10, 2017

(87) PCT Pub. No.: WO2016/057932
PCT Pub. Date: Apr. 14, 2016

(65) Prior Publication Data
US 2017/0306332 A1    Oct. 26, 2017

Related U.S. Application Data

(60) Provisional application No. 62/062,424, filed on Oct. 10, 2014, provisional application No. 62/199,056, filed on Jul. 30, 2015.

(51) Int. Cl.
*C12N 15/113* (2010.01)

(52) U.S. Cl.
CPC .. *C12N 15/1137* (2013.01); *C12Y 101/01027* (2013.01); *C12N 2310/14* (2013.01); *C12N 2310/315* (2013.01); *C12N 2310/332* (2013.01); *C12N 2310/533* (2013.01); *C12N 2320/32* (2013.01)

(58) Field of Classification Search
None
See application file for complete search history.

(56) References Cited

U.S. PATENT DOCUMENTS

| | | | |
|---|---|---|---|
| 2010/0173973 A1 | 7/2010 | Brown | |
| 2011/0207799 A1* | 8/2011 | Rozema | A61K 9/08 514/44 A |
| 2011/0288147 A1* | 11/2011 | Brown | C12N 15/113 514/44 A |
| 2012/0121515 A1* | 5/2012 | Dang | C12Y 101/01042 424/9.3 |

FOREIGN PATENT DOCUMENTS

| | | |
|---|---|---|
| JP | 2014-518626 | 8/2014 |
| WO | WO 2005/089287 A2 | 9/2005 |
| WO | WO 2005/116204 A1 | 12/2005 |
| WO | WO 2006/006948 A2 | 1/2006 |
| WO | WO 2008/136902 A1 | 11/2008 |
| WO | WO 2012/156513 A1 | 11/2012 |

OTHER PUBLICATIONS

Ping Miao, et al., "Lactate dehydrogenase a in cancer: A promising target for diagnosis and therapy", IUBMB LIFE, vol. 65, No. 11, Nov. 1, 2013, pp. 904-910.
Shi L. Sheng et al., "Knockdown of lactate dehydrogenase A suppresses tumor growth and metastasis of human hepatocellular carcinoma", FEBS Journal, vol. 279, No. 20, Sep. 13, 2012, pp. 3898-3910.
Zhi-Yu Wang et al., "LDH-A silencing suppresses breast cancer tumorigenicity through induction of oxidative stress mediated mitochondrial pathway apoptosis", Breast Cancer Research and Treatment, Kluwer Academic Publishers, BO, vol. 131, No. 3, Mar. 31, 2011, pp. 791-800.
Langhammer S et al., "LDH-A gene suppression affects cell growth of colon carcinoma xenografts but not in culture conditions", European Journal of Cancer. Supplement, Pergamon, Oxford, GB, vol. 6, No. 9, Jul. 2, 2008, pp. 21-22.
Adeva M. et al., "Enzymes involved inl-lactate metabolism in humans", MITOCHONDRION, vol. 13, No. 6, 2013, pp. 615-629.
International Search Report issued in corresponding International Application Serial No. PCT/US2015/054959, dated Mar. 29, 2016, 6 pages.
Written Opinion of the International Searching Authority issued in corresponding International Application Ser. No. PCT/US2015/054959, dated Mar. 29, 2016, 11 pages.

* cited by examiner

*Primary Examiner* — J. E. Angell
(74) *Attorney, Agent, or Firm* — Wolf, Greenfield & Sacks, P.C.; Byron V. Olsen

(57) ABSTRACT

This invention relates to compounds, compositions, and methods useful for reducing lactate dehydrogenase target RNA and protein levels via use of dsRNAs, e.g., Dicer substrate siRNA (DsiRNA) agents.

34 Claims, 43 Drawing Sheets

Specification includes a Sequence Listing.

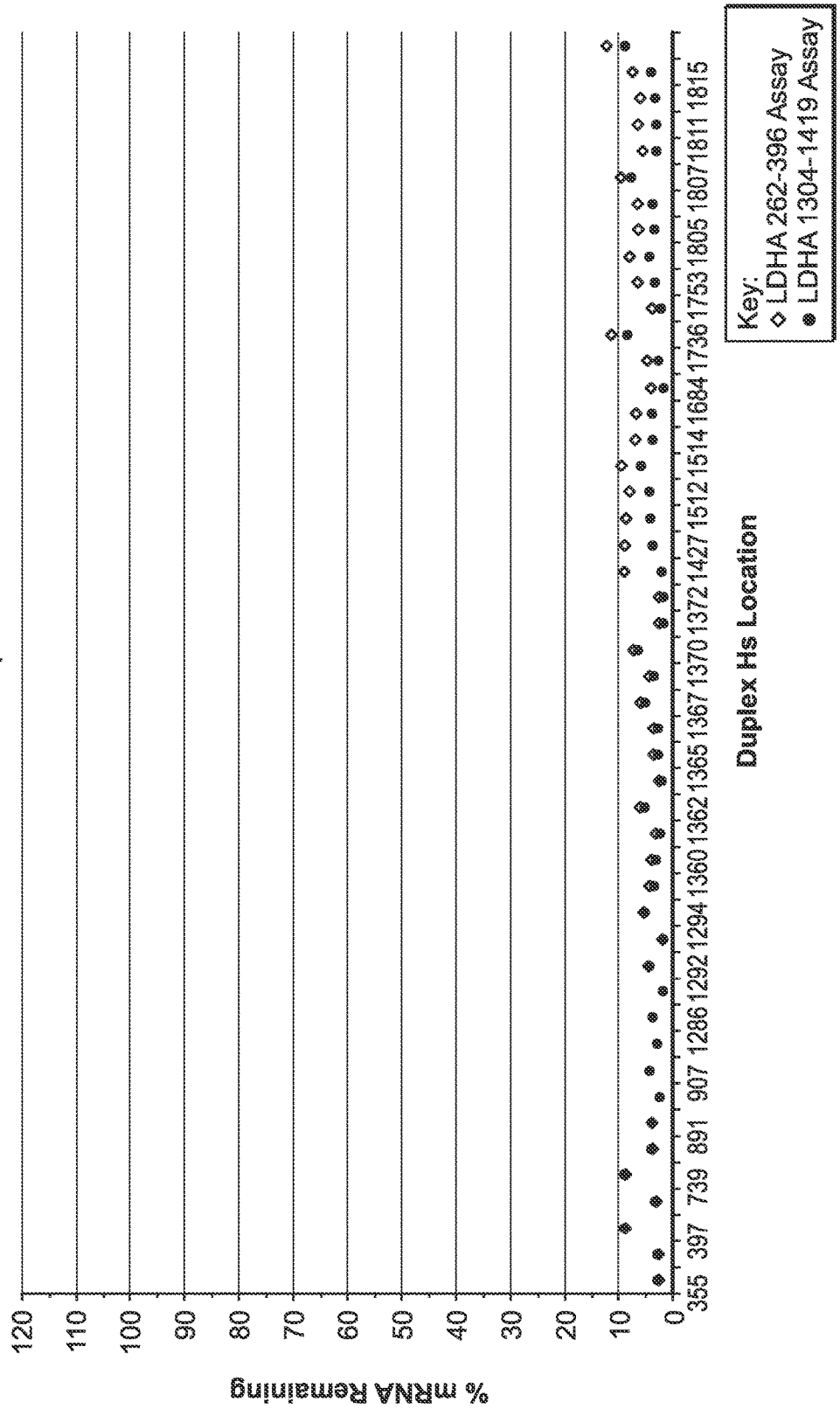

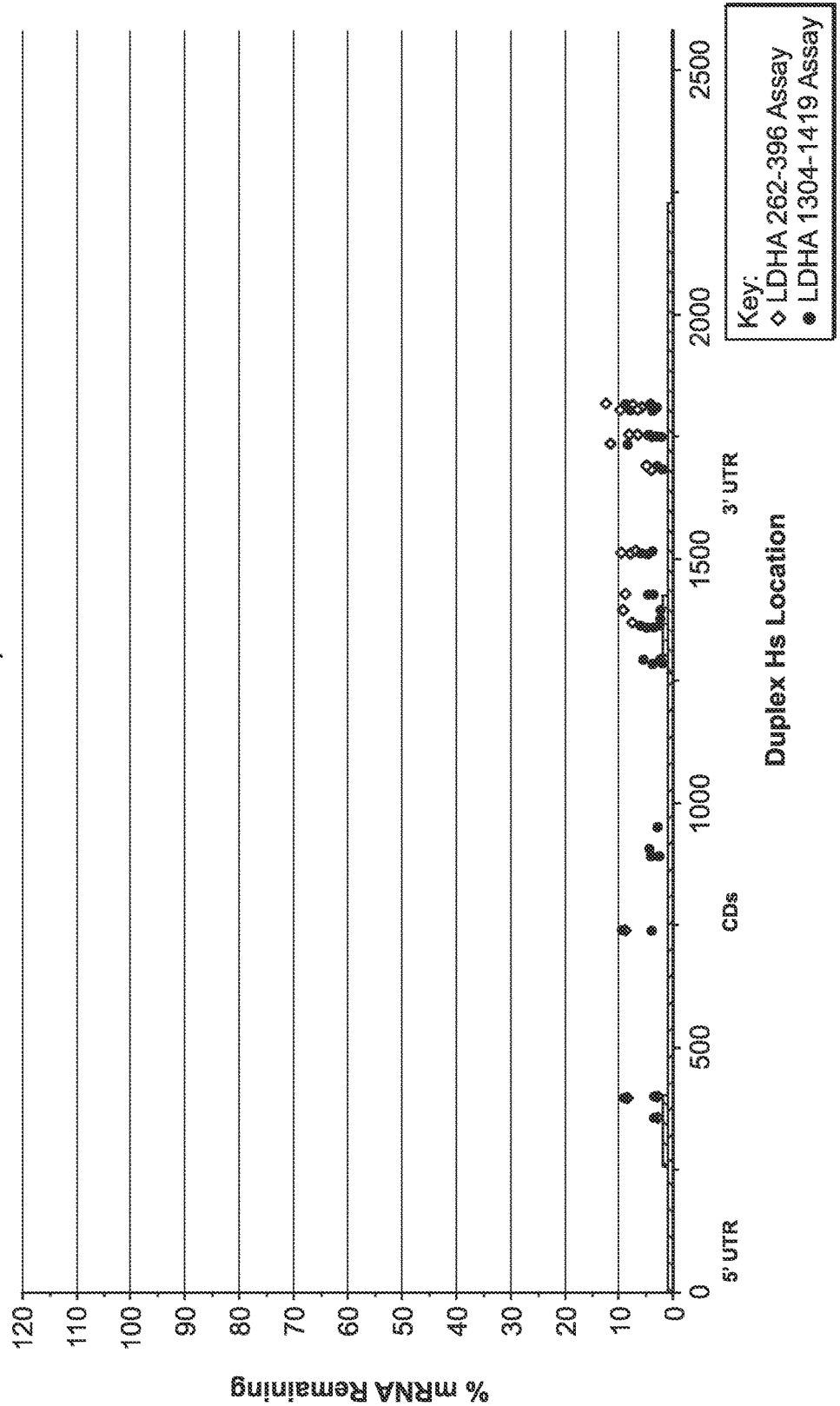

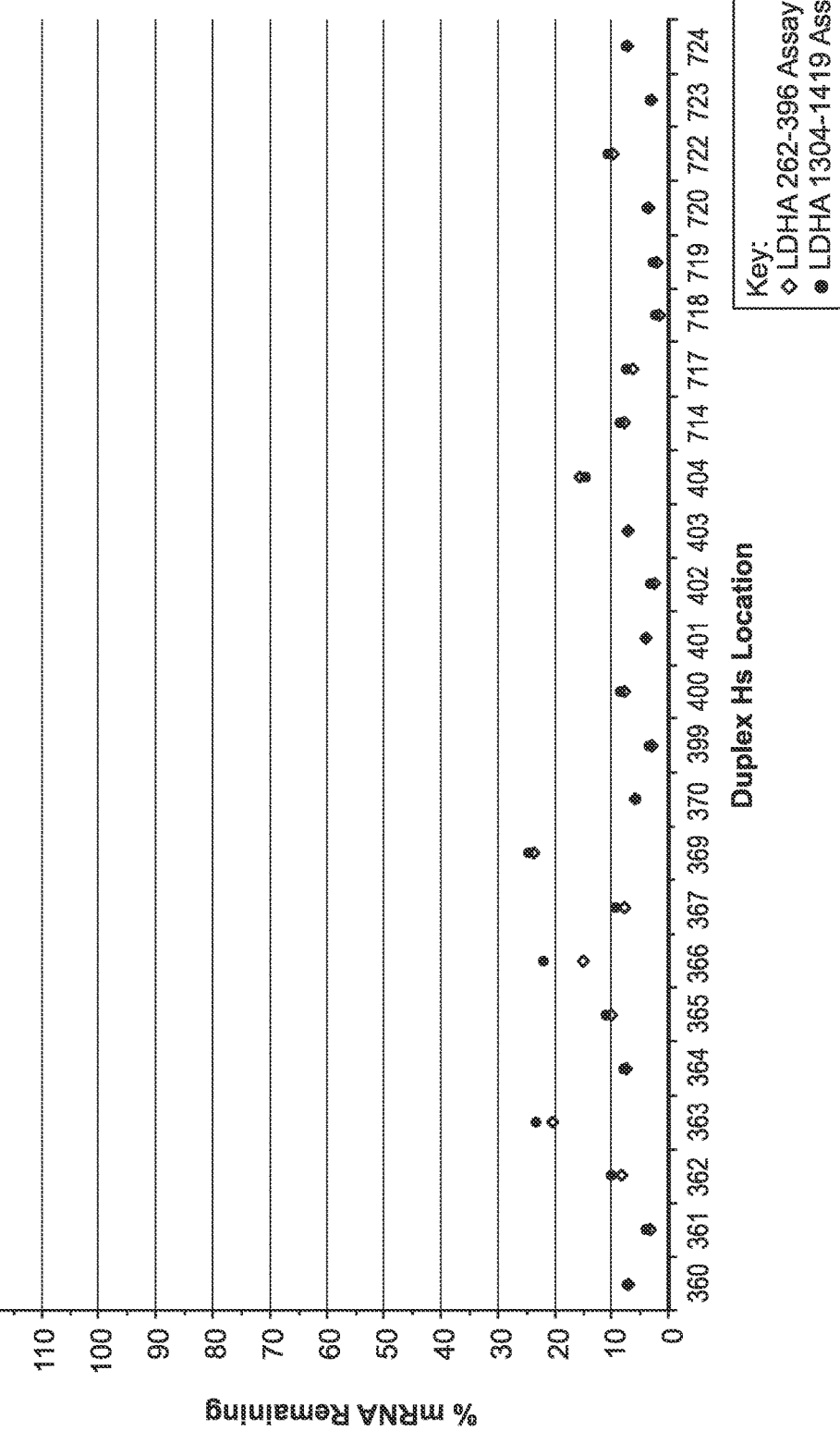

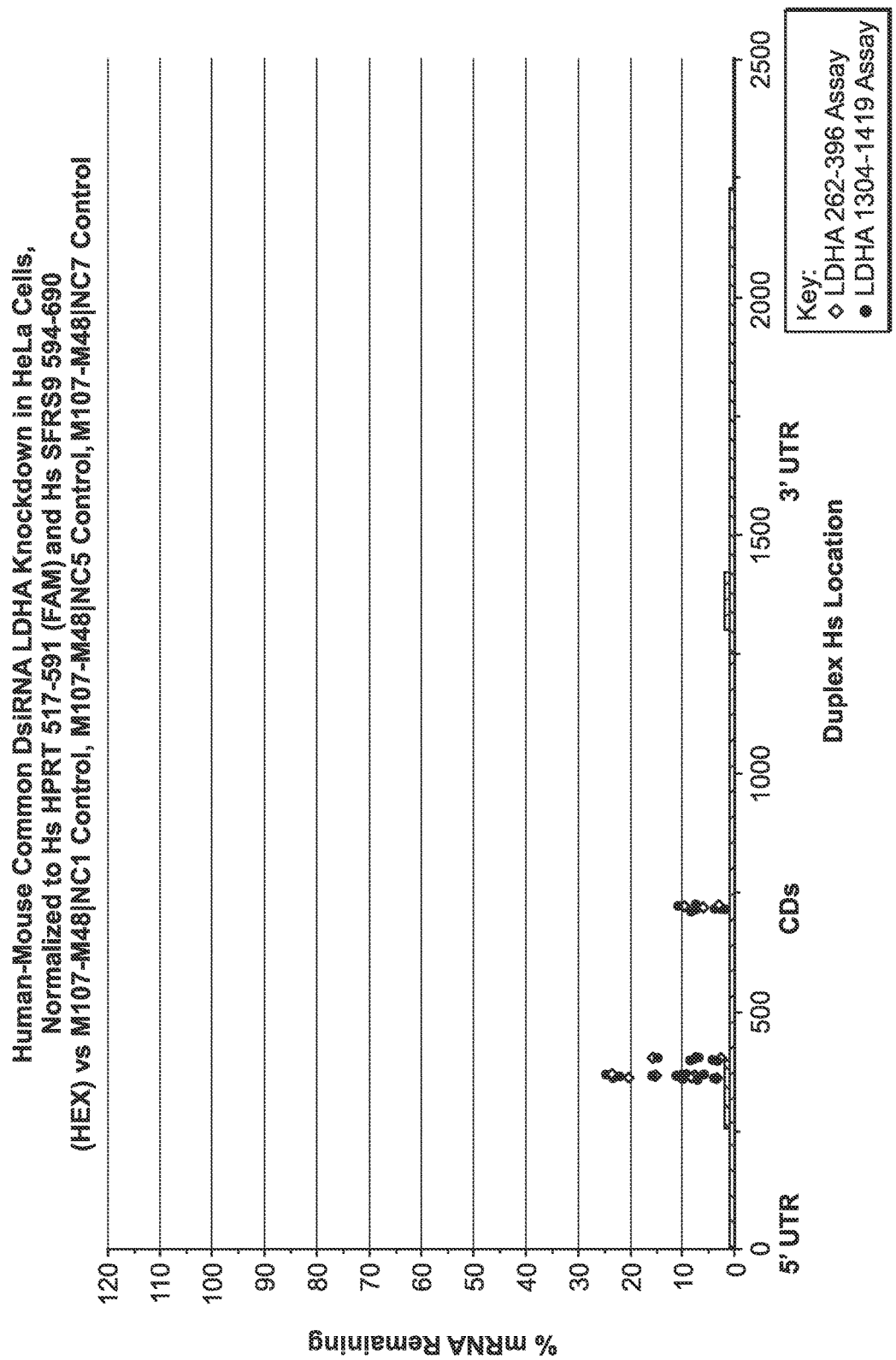

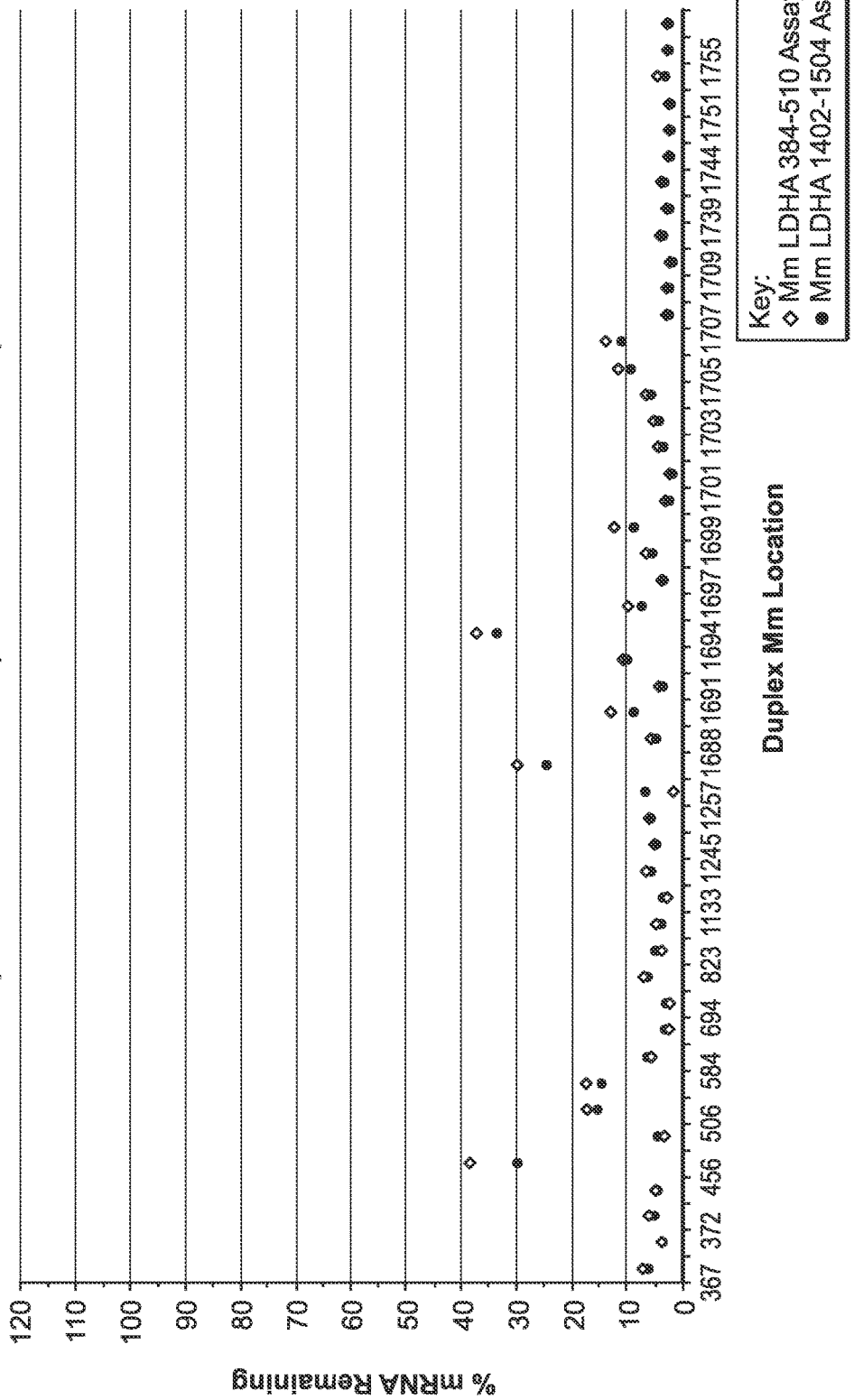

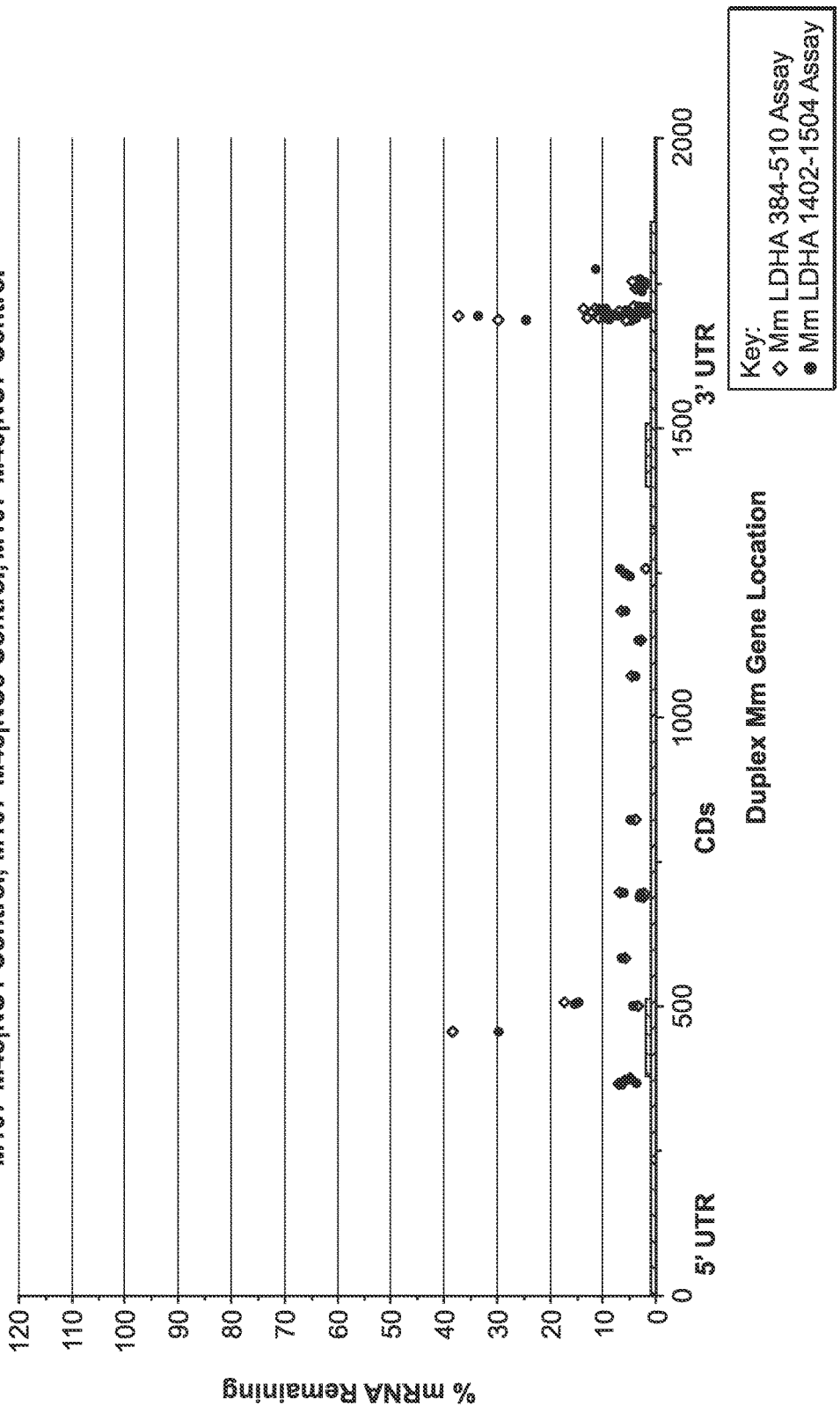

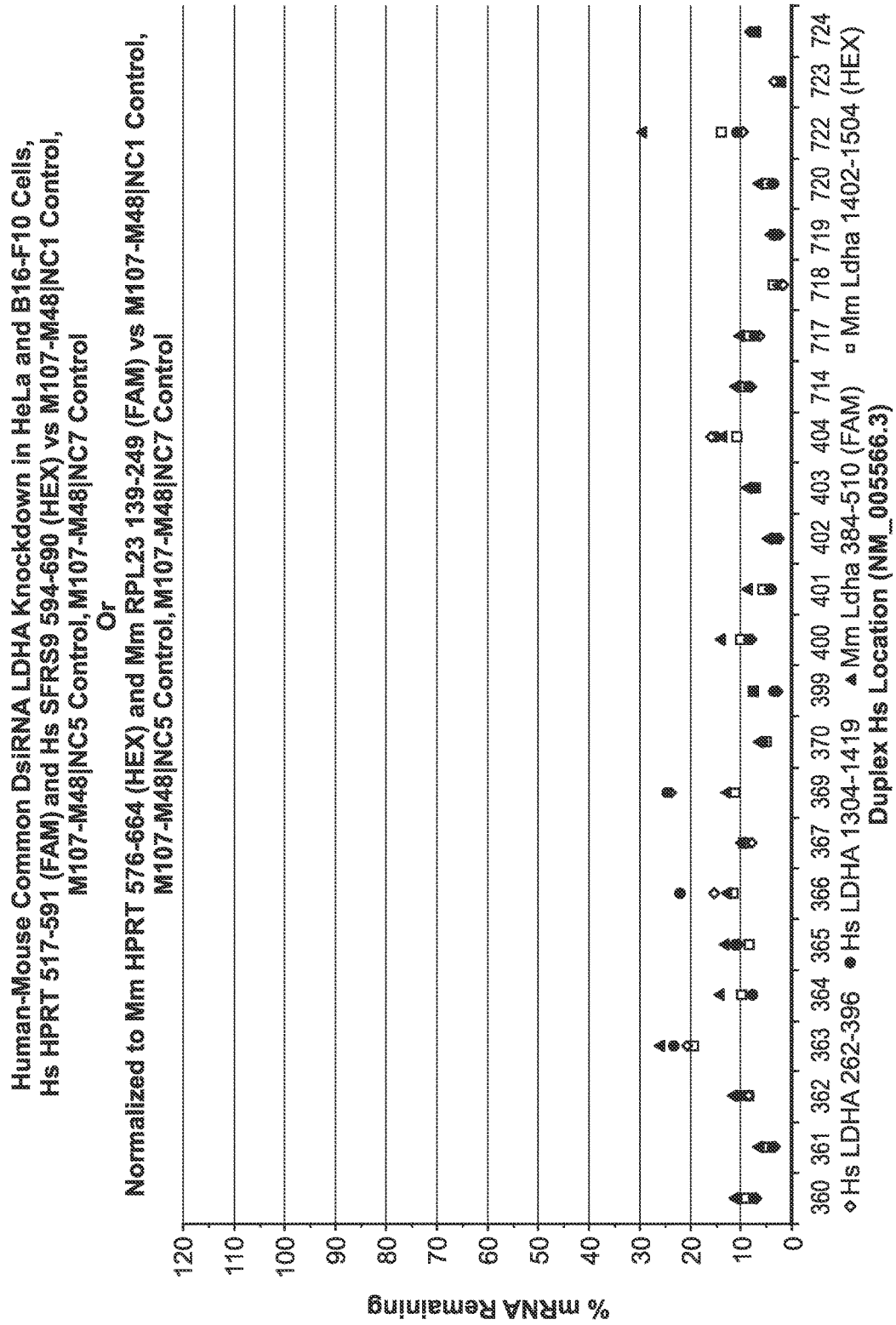

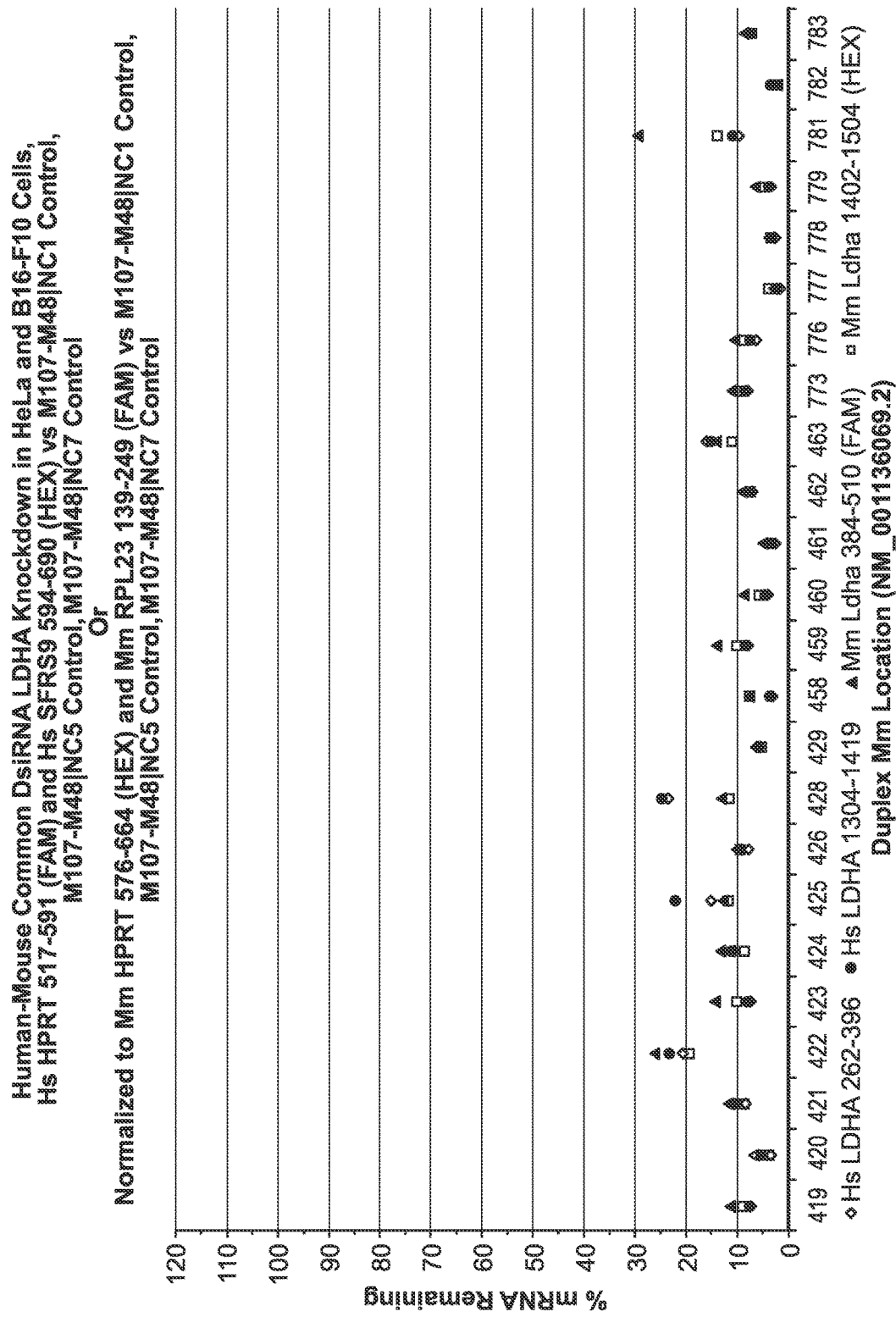

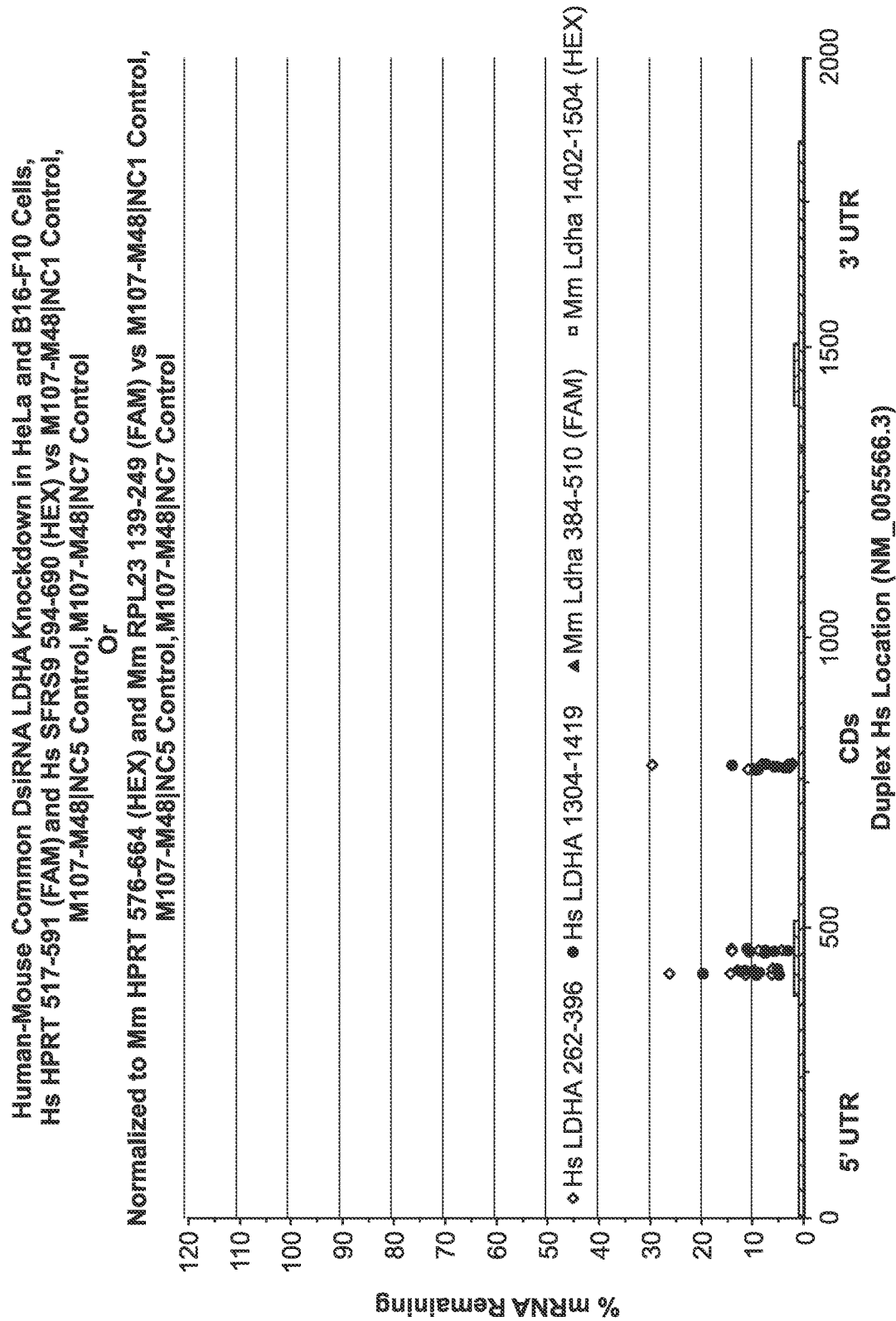

Significant knockdown of PRODH2, LDHA, GO, and AGXT mRNA and protein
Western analysis Reduced LDH activity in liver extracts

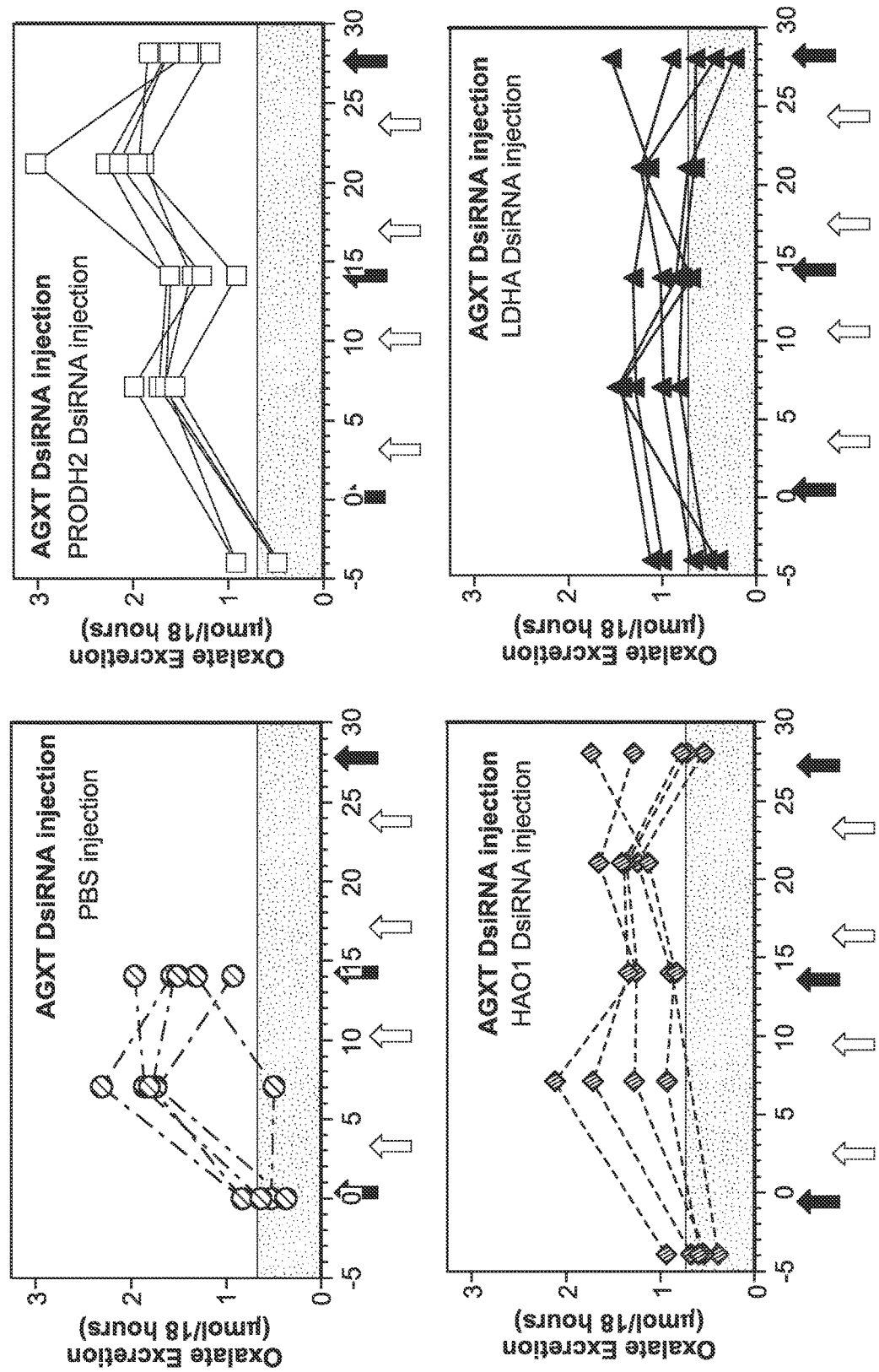

AGXT DsiRNA injection
HAO1, PRODH2 or LDHA DsiRNA injection

AGXT DsiRNA injection
HAO1, PRODH2 or LDHA DsiRNA injection

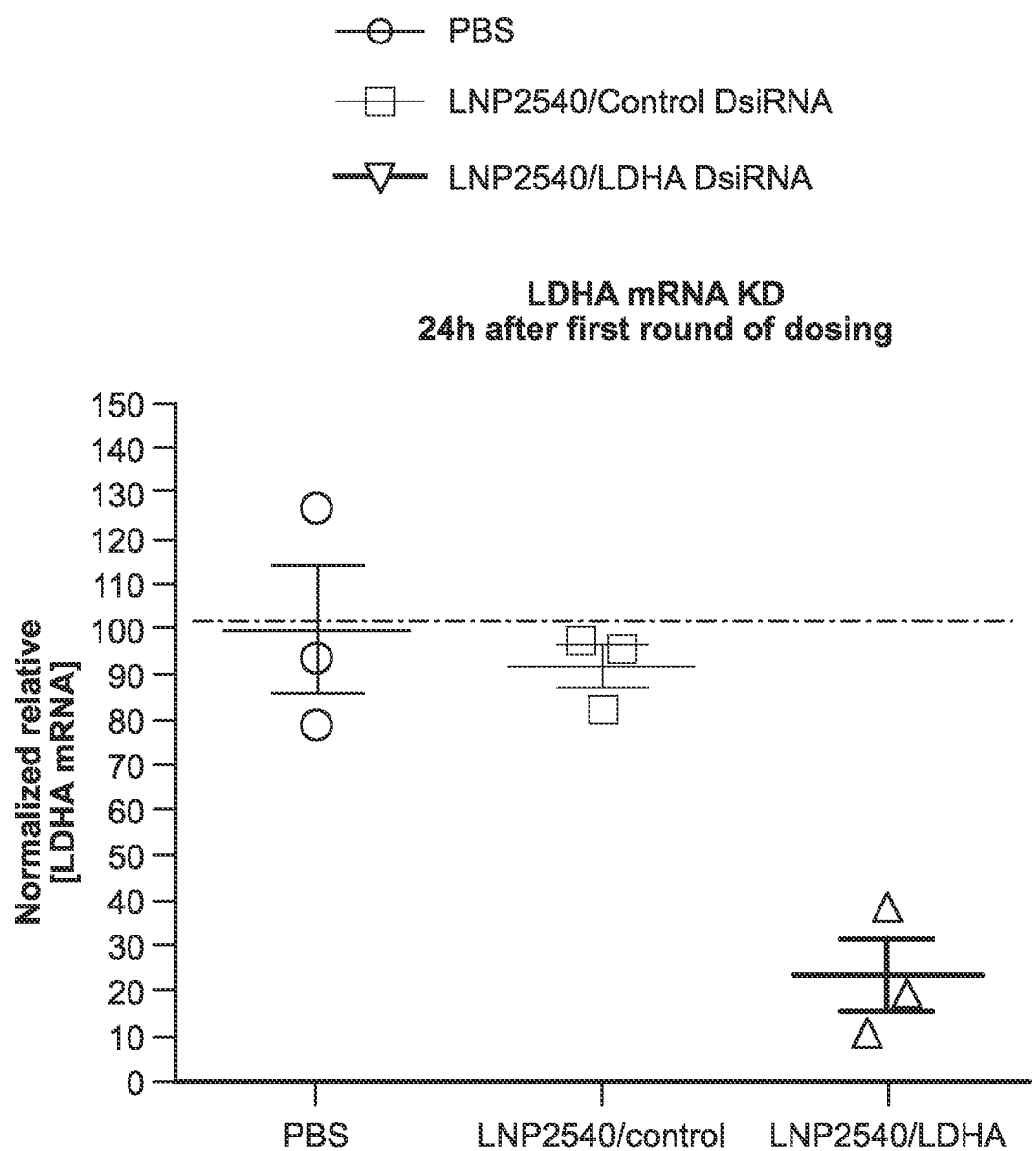

THERAPEUTIC INHIBITION OF LACTATE DEHYDROGENASE AND AGENTS THEREFOR

CROSS-REFERENCE TO RELATED APPLICATIONS

This application is the U.S. national stage pursuant to 35 U.S.C. § 371, of International Application Ser. No. PCT/US2015/054959, filed Oct. 9, 2015 and published in English on Apr. 14, 2016 as publication WO 2016/057932 A1, which is related to U.S. Provisional Patent Application Ser. No. 62/062,424, entitled "Methods and Compositions for the Specific Inhibition of Lactate Dehydrogenase by Double-Stranded RNA", which was filed Oct. 10, 2014, and to U.S. Provisional Patent Application Ser. No. 62/199,056, entitled "Therapeutic Inhibition of Lactate Dehydrogenase and Agents Therefor", which was filed Jul. 30, 2015. The entire contents of the preceding patent applications are hereby incorporated by reference herein.

FIELD OF THE INVENTION

The present invention relates to compounds, compositions, and methods for the study, diagnosis, and treatment of traits, diseases and conditions that respond to the modulation of lactate dehydrogenase gene expression and/or activity.

SEQUENCE SUBMISSION

The present application is being filed along with a Sequence Listing in electronic format. The Sequence Listing is entitled "48292_514001WO_Seq_Listing_9OCT2015", was created on Oct. 9, 2015, and is 1.4 MB in size. The information in the electronic format of the Sequence Listing is part of the present application and is incorporated herein by reference in its entirety.

BACKGROUND OF THE INVENTION

Primary hyperoxaluria Type 1 ("PH1") is a rare autosomal recessive inborn error of glyoxylate metabolism, caused by a deficiency of the liver-specific enzyme alanine:glyoxylate aminotransferase (also named serine-pyruvate aminotransferase). The disorder results in overproduction and excessive urinary excretion of oxalate, causing recurrent urolithiasis and nephrocalcinosis. As glomerular filtration rate declines due to progressive renal involvement, oxalate accumulates leading to systemic oxalosis. The diagnosis is based on clinical and sonographic findings, urine oxalate assessment, enzymology and/or DNA analysis. While early conservative treatment has aimed to maintain renal function, in chronic kidney disease Stages 4 and 5, the best outcomes to date have been achieved with combined liver-kidney transplantation (Cochat et al. *Nephrol Dial Transplant* 27: 1729-36).

PH1 is the most common form of primary hyperoxaluria and has an estimated prevalence of 1 to 3 cases per 1 million population and an incidence rate of approximately 1 case per 120,000 live births per year in Europe (Cochat et al. *Nephrol Dial Transplant* 10 (Suppl 8): 3-7; van Woerden et al. Nephrol Dial Transplant 18: 273-9). It accounts for 1 to 2% of cases of pediatric end-stage renal disease (ESRD), according to registries from Europe, the United States, and Japan (Harambat et al. *Clin J Am Soc Nephrol* 7: 458-65), but it appears to be more prevalent in countries in which consanguineous marriages are common (with a prevalence of 10% or higher in some North African and Middle Eastern nations; Kamoun and Lakhoua Pediatr Nephrol 10: 479-82; see Cochat and Rumsby *N Engl J Med* 369(7):649-58).

Lactate dehydrogenase (LDH) is the enzyme responsible for converting glyoxylate to oxalate in the mitochondrial/peroxisomal glycine metabolism pathway in the liver and pancreas. In the presence of LDH, increased production of glyoxylate (via, e.g., AGT1 mutation) drives oxalate accumulation (see FIG. 2), which ultimately results in the PH1 disease.

Double-stranded RNA (dsRNA) agents possessing strand lengths of 25 to 35 nucleotides have been described as effective inhibitors of target gene expression in mammalian cells (Rossi et al., U.S. Pat. No. 8,084,599 and U.S. Patent Application No. 2005/0277610). dsRNA agents of such length are believed to be processed by the Dicer enzyme of the RNA interference (RNAi) pathway, leading such agents to be termed "Dicer substrate siRNA" ("DsiRNA") agents. Additional modified structures of DsiRNA agents were previously described (Rossi et al., U.S. Patent Application No. 2007/0265220). Effective extended forms of Dicer substrates have also recently been described (see, e.g., Brown, U.S. Pat. Nos. 8,349,809 and 8,513,207).

Provided herein are improved nucleic acid agents that target lactate dehydrogenase. In particular, those targeting lactate dehydrogenase have been specifically exemplified.

BRIEF SUMMARY OF THE INVENTION

The present invention is based, at least in part, upon the identification of lactate dehydrogenase as an attractive target for RNA-based (particularly dsRNA-based) knockdown therapies. It was surprisingly identified herein that targeted knockdown of lactate dehydrogenase that appeared to exclude muscle tissue as a target organ for LDHA knockdown (e.g., primarily liver-targeted knockdown, e.g., using LNP-mediated delivery and/or GalNAc dsNA conjugates), such as can be achieved via use of dsRNAs as described herein in concert with delivery modalities (e.g., lipid nanoparticles, GalNAc conjugates, etc.) could provide therapeutic benefit to a subject having chronic kidney disease and/or pyruvate dehydrogenase complex deficiency. Identification of a therapeutic effect of such modalities when used against diseases or disorders such as chronic kidney disease, pyruvate dehydrogenase complex deficiency, or against PH1 (see, e.g., Example 4 and FIGS. 5A to 5G herein) and/or any other lactate dehydrogenase-associated disease or disorder, including, e.g., PH2 (see, e.g., Example 5 and FIG. 5H herein), PH3 and idiopathic hyperoxaluria, as well as oncology (when delivered in a manner that tends to target liver cells while being inefficient for muscle delivery, e.g., within a LNP—see, e.g., Example 7 and FIGS. 10A to 10B herein), was noted as remarkable, at least in part because of the critical role of lactate dehydrogenase in glycolysis. In particular, elevated lactose levels are known to be highly deleterious to cells and tissues, e.g., particularly in muscle and other tissues, and the robust levels of lactate dehydrogenase knockdown likely to be achieved using RNAi agents would therefore have been predicted to be harmful to a subject, in the absence of evidence to the contrary. However, the therapeutic potential of such approaches has now been identified herein, as the therapeutic modalities described herein have been established herein not only as effective but also well-tolerated (i.e., it has been discovered herein that robust knockdown of LDHA in liver does not produce a corresponding and potentially deleterious elevation of lactate levels in the circulation of mice—see, e.g., Example 8 and FIG. 11 herein).

The currently described LDHA-targeting therapies can be readily distinguished from small molecule-based approaches to performing LDHA inhibition (refer, e.g., to Shi and Pinto PLoS ONE 9(1): e86365 for certain small molecule inhibitors of LDHA). In particular, inhibition of LDHA using small molecule inhibitors cannot be readily targeted to specific organs without any impact upon other organs (e.g., without significant partitioning to muscle cells), due at least in part to the small sizes and partition coeffeicients of such small molecules.

Another disadvantage of small molecule-based approaches to inhibiting LDHA that is overcome by the oligonucleotide-based approaches of the current invention is the tendency of small molecule inhibitors of LDHA also to target other forms of LDH, for example, LDHB and/or LDHC. Such non-selective targeting of multiple forms of LDH can lead to more severe negative side effects in a treated individual than the truly LDHA-specific oligonucleotide-based therapies described herein.

Targeting of LDHA, especially using small molecule inhibitors that are not preferentially selective for LDHA relative to LDHB and/or LDHC, has been previously identified as an oncology therapy; however, use of LNP-mediated forms of oligonucleotide therapeutic delivery are identified herein as allowing for delivery of LDHA inhibitory activity to optimal target organs and/or tumors, while largely preventing anti-LDHA activity in tissues and/or organs where LDHA knockdown might be highly deleterious in certain individuals (e.g., in muscle cells of individuals having chronic kidney disease, pyruvate dehydrogenase complex deficiency, PH1 and/or any other lactate dehydrogenase-associated disease or disorder, including, e.g., PH2, PH3 and idiopathic hyperoxaluria, as well as certain types of cancer). Thus, LNP-mediated anti-LDHA RNAi agent delivery that tends not to deliver to muscle cells of a subject yet delivers to other target organs (including, e.g., tumor) is also identified herein as a highly attractive method for treating neoplasia in a subject.

In one aspect, the invention provides a method for treating a lactate dehydrogenase knockdown-treatable disease or disorder (e.g., chronic kidney disease, pyruvate dehydrogenase complex deficiency, PH1, PH2, PH3 and/or idiopathic hyperoxaluria) in a subject, involving administering to a subject having such a disease or disorder an agent that reduces expression of the LDHA gene in one or more tissues of the subject, thereby treating the disease or disorder in the subject.

In one embodiment, the subject has or is at elevated risk of chronic kidney disease or pyruvate dehydrogenase complex deficiency.

In another embodiment, the agent that reduces expression of the LDHA gene is an RNAi agent, optionally a double stranded nucleic acid ("dsNA"). Optionally, the agent is an RNAi agent having a hairpin or a tetraloop structure.

In certain embodiments, an agent of the invention is administered in a lipid nanoparticle. In related embodiments, administration of the agent largely targets the liver. Optionally, administration of the agent preferentially targets a neoplasia tissue. In certain embodiments, the agent is not delivered to muscle tissue (or is delivered to muscle tissue at very low levels as compared to, e.g., liver tissue).

In an additional embodiment, the one or more tissues of the subject include liver.

Another aspect of the invention provides a method for treating a neoplasia in a subject in need thereof, involving administering to a subject having a neoplasia an LNP-packaged agent that reduces expression of the LDHA gene in one or more tissues of the subject, thereby treating the neoplasia in the subject.

In one embodiment, the neoplasia is a hepatic tumor, e.g., hepatocellular carcinoma.

In another embodiment, administering of the agent does not reduce LDHA gene expression in muscle tissues of the subject.

Optionally, the agent preferentially reduces LDHA gene expression as compared to LDHB gene expression in the subject. In a related embodiment, LDHB gene expression is not reduced in the subject.

In certain embodiments, the agent that reduces expression of the LDHA gene is an RNAi molecule, optionally a double stranded nucleic acid ("dsNA").

In another embodiment, the agent that reduces expression of the LDHA gene is an RNAi molecule possessing a hairpin or a tetraloop structure.

In an additional embodiment, the agent that reduces expression of the LDHA gene is an RNAi molecule or a single-stranded antisense oligonucleotide.

In a related embodiment, the agent is a modified oligonucleotide. Optionally, the agent includes one or more of the following modifications: 2'-fluoro (2'-F), 2'-OMethyl (2'-OMe) and/or 2'-Methoxy ethoxy (2'-MOE) sugar modifications, inverted abasic caps, deoxynucleobases, and/or bicyclic nucleobase analogs such as locked nucleic acids (including LNA) and/or ENA In one embodiment, the agent includes an oligonucleotide of between 12 and 80 or more nucleotides in length.

In certain embodiments, the agent is an RNAi agent having one of the following structures:

a dsNA having a first oligonucleotide strand having a 5' terminus and a 3' terminus and a second oligonucleotide strand having a 5' terminus and a 3' terminus, where each of the 5' termini has a 5' terminal nucleotide and each of the 3' termini has a 3' terminal nucleotide, where the first strand is 15-30 nucleotide residues in length, where starting from the 5' terminal nucleotide (position 1) positions 1 to 15 of the first strand include at least 8 ribonucleotides; the second strand is 36-80 nucleotide residues in length and, starting from the 3' terminal nucleotide, includes at least 8 ribonucleotides in the positions paired with positions 1-15 of the first strand to form a duplex; where at least the 3' terminal nucleotide of the second strand is unpaired with the first strand, and up to 6 consecutive 3' terminal nucleotides are unpaired with the first strand, thereby forming a 3' single stranded overhang of 1-6 nucleotides; where the 5' terminus of the second strand includes from 5-64 consecutive nucleotides which are unpaired with the first strand, thereby forming a 5-64 nucleotide single stranded 5' overhang; where at least the first strand 5' terminal and 3' terminal nucleotides are base paired with nucleotides of the second strand when the first and second strands are aligned for maximum complementarity, thereby forming a substantially duplexed region between the first and second strands; and the second strand is sufficiently complementary to a target RNA along at least 19 ribonucleotides of the second strand length to reduce target gene expression when the double stranded nucleic acid is introduced into a mammalian cell;

a dsNA having a first oligonucleotide strand having a 5' terminus and a 3' terminus and a second oligonucleotide strand having a 5' terminus and a 3' terminus, where each of the 5' termini has a 5' terminal nucleotide and each of the 3' termini has a 3' terminal nucleotide, where the second strand is 19-30 nucleotide residues in length, where starting from the 5' terminal nucleotide (position 1) positions 1 to 19 of the second strand include at least 8 ribonucleotides; the first strand is 25-80 nucleotide residues in length and includes at least 8 ribonucleotides in positions paired with positions 1-19 of the second strand to form a duplex; where the 3' terminal nucleotide of the first strand is paired with the second strand, forming a blunt end, or up to 6 consecutive 3' terminal nucleotides are unpaired with the second strand, thereby forming a 3' single stranded overhang of 1-6 nucleotides; where the 5' terminus of the first strand includes from 5-61 consecutive nucleotides which are unpaired with the second strand, thereby forming a 5-61 nucleotide single stranded 5' overhang; where at least the second strand 5' terminal and 3' terminal nucleotides are base paired with nucleotides of the first strand when the first and second strands are aligned for maximum complementarity, thereby forming a substantially duplexed region between the first and second strands; and the second strand is sufficiently complementary to a target RNA along at least 19 ribonucleotides of the second strand length to reduce target gene expression when the double stranded nucleic acid is introduced into a mammalian cell; or a dsNA having a first strand and a second strand, where the first strand and the second strand form a duplex region of 19-25 nucleotides in length, where the first strand has a 3' region that extends beyond the first strand-second strand duplex region and includes a nucleotide linker region, and the dsNA further includes a discontinuity between the 3' terminus of the first strand and the 5' terminus of the second strand, and the first or second strand is sufficiently complementary to a target lactate dehydrogenase mRNA sequence of SEQ ID NOs: 361-432 along at least 15 nucleotides of the second strand length to reduce lactate dehydrogenase target mRNA expression when the dsNA is introduced into a mammalian cell.

In certain embodiments, the nucleotide linker includes a tetraloop, optionally the nucleotide linker is a tetraloop.

In some embodiments, the agent includes one or more dynamic polyconjugate and/or GalNAc conjugate moieties.

In certain additional aspects, provided herein are nucleic acid compositions that reduce expression of lactate dehydrogenase. Such compositions contain nucleic acids such as double stranded RNA ("dsRNA"), and methods for preparing them. The nucleic acids of the invention are capable of reducing the expression of a target lactate dehydrogenase gene in a cell, either in vitro or in a mammalian subject.

In one aspect, the invention provides a nucleic acid having an oligonucleotide strand of 15-35 nucleotides in length that is sufficiently complementary to a target lactate dehydrogenase mRNA sequence of SEQ ID NOs: 361-432 along at least 15 nucleotides of the oligonucleotide strand length to reduce lactate dehydrogenase target mRNA expression when the nucleic acid is introduced into a mammalian cell. Optionally, the oligonucleotide strand is 19-35 nucleotides in length.

In another aspect, the invention provides a nucleic acid having an oligonucleotide strand of 19-35 nucleotides in length that is sufficiently complementary to a target lactate dehydrogenase mRNA sequence of SEQ ID NOs: 361-432 along at least 19 nucleotides of the oligonucleotide strand length to reduce lactate dehydrogenase target mRNA expression when the nucleic acid is introduced into a mammalian cell.

In a further aspect, the invention provides a double stranded nucleic acid (dsNA) having first and second nucleic acid strands that include RNA, where the first strand is 15-80 nucleotides in length and the second strand is 19-80 nucleotides in length and is sufficiently complementary to a target lactate dehydrogenase mRNA sequence of SEQ ID NOs: 361-432 along at least 15 nucleotides of the second oligonucleotide strand length to reduce lactate dehydrogenase target mRNA expression when the dsNA is introduced into a mammalian cell.

Optionally, the first strand is 15-53, 15-35, 19-53 or 19-35 nucleotides in length. In certain embodiments, the second strand is 19-53 or 19-35 nucleotides in length.

In an additional aspect, the invention provides a dsNA having first and second nucleic acid strands, where the first strand is 15-35 nucleotides in length and the second strand of the dsNA is 19-35 nucleotides in length and is sufficiently complementary to a target lactate dehydrogenase mRNA sequence of SEQ ID NOs: 361-432 along at least 19 nucleotides of the second oligonucleotide strand length to reduce lactate dehydrogenase target mRNA expression when the dsNA is introduced into a mammalian cell.

In another aspect, the invention provides a dsNA having first and second nucleic acid strands, where the first strand is 15-35 nucleotides in length and the second strand of the dsNA is 19-35 nucleotides in length and is sufficiently complementary to a target lactate dehydrogenase mRNA sequence of SEQ ID NOs: 361-432 along at least 19 nucleotides of the second oligonucleotide strand length to reduce lactate dehydrogenase target mRNA expression, and where, starting from the 5' end of the lactate dehydrogenase mRNA sequence of SEQ ID NOs: 361-432 (referred to as position 1), mammalian Ago2 cleaves the mRNA at a site between positions 9 and 10 of the sequence when the dsNA is introduced into a mammalian cell.

In a further aspect, the invention provides a dsNA molecule that consists of (a) a sense region and an antisense region, where the sense region and the antisense region together form a duplex region consisting of 25-35 base pairs and the antisense region comprises a sequence that is the complement of a sequence of any one (or more) of SEQ ID NOs: 361-432; and (b) from zero to two 3' overhang regions, where each overhang region is six or fewer nucleotides in length, and where, starting from the 5' end of the lactate dehydrogenase mRNA sequence of SEQ ID NOs: 361-432 (position 1), mammalian Ago2 cleaves the mRNA at a site between positions 9 and 10 of the sequence when the dsNA is introduced into a mammalian cell.

In an additional aspect, the invention provides a dsNA having first and second nucleic acid strands and a duplex region of at least 25 base pairs, where the first strand is 25-34 nucleotides in length and the second strand of the dsNA is 26-35 nucleotides in length and includes 1-5 single-stranded nucleotides at its 3' terminus, where the second oligonucleotide strand is sufficiently complementary to a target lactate dehydrogenase mRNA sequence of SEQ ID NOs: 361-432 along at least 19 nucleotides of the second oligonucleotide strand length to reduce lactate dehydrogenase target gene expression when the dsNA is introduced into a mammalian cell.

In another aspect, the invention provides a dsNA having first and second nucleic acid strands and a duplex region of at least 25 base pairs, where the first strand is 25-34 nucleotides in length and the second strand of the dsNA is 26-35 nucleotides in length and comprises 1-5 single-stranded nucleotides at its 3' terminus, where the 3' terminus of the first oligonucleotide strand and the 5' terminus of the second oligonucleotide strand form a blunt end, and second oligonucleotide strand is sufficiently complementary to a target lactate dehydrogenase sequence of SEQ ID NOs: 361-432 or 5109-7122 along at least 19 nucleotides of the second oligonucleotide strand length to reduce lactate dehydrogenase mRNA expression when the dsNA is introduced into a mammalian cell.

In an additional aspect, the invention provides a nucleic acid possessing an oligonucleotide strand of 15-35 nucleotides in length, where the oligonucleotide strand is hybridizable to a target lactate dehydrogenase mRNA sequence of SEQ ID NOs: 361-432 along at least 15 nucleotides of the oligonucleotide strand length.

Another aspect of the invention provides a dsNA having first and second nucleic acid strands that include RNA, where the first strand is 15-35 nucleotides in length and the second strand of the dsNA is 19-35 nucleotides in length, where the second oligonucleotide strand is hybridizable to a target lactate dehydrogenase mRNA sequence of SEQ ID NOs: 361-432 along at least 15 nucleotides of the second oligonucleotide strand length.

Other aspects of the invention provide a dsNA that is:

a dsNA comprising a first oligonucleotide strand having a 5' terminus and a 3' terminus and a second oligonucleotide strand having a 5' terminus and a 3' terminus, where the first strand is 25 to 53 nucleotide residues in length, where starting from the first nucleotide (position 1) at the 5' terminus of the first strand, positions 1 to 23 of the first strand are ribonucleotides or modified ribonucleotides; the second strand is 27 to 53 nucleotide residues in length and comprises 23 consecutive ribonucleotides or modified ribonucleotides that base pair with the ribonucleotides or ribonucleotides of positions 1 to 23 of the first strand to form a duplex; the 5' terminus of the first strand and the 3' terminus of the second strand form a blunt end, a 1-6 nucleotide 5' overhang or a 1-6 nucleotide 3' overhang; the 3' terminus of the first strand and the 5' terminus of the second strand form a blunt end, a 1-6 nucleotide 5' overhang or a 1-6 nucleotide 3' overhang; at least one of positions 24 to the 3' terminal nucleotide residue of the first strand is a deoxyribonucleotide or modified ribonucleotide that optionally base pairs with a deoxyribonucleotide of the second strand; and the second strand is sufficiently complementary to a target lactate dehydrogenase mRNA sequence selected from SEQ ID NOs: 361-432 along at least 15 nucleotides of the second oligonucleotide strand length to reduce lactate dehydrogenase target mRNA expression when the double stranded nucleic acid is introduced into a mammalian cell;

a dsNA comprising a first oligonucleotide strand having a 5' terminus and a 3' terminus and a second oligonucleotide strand having a 5' terminus and a 3' terminus, where the second strand is 27 to 53 nucleotide residues in length, where starting from the first nucleotide (position 1) at the 5' terminus of the second strand, positions 1 to 23 of the second strand are ribonucleotides or modified ribonucleotides; the first strand is 25 to 53 nucleotide residues in length and comprises 23 consecutive ribonucleotides or modified ribonucleotides that base pair sufficiently with the ribonucleotides of positions 1 to 23 of the second strand to form a duplex; at least one of positions 24 to the 3' terminal nucleotide residue of the second strand is a deoxyribonucleotide or modified ribonucleotide, optionally that base pairs with a deoxyribonucleotide or modified ribonucleotide of the first strand; and the second strand is sufficiently complementary to a target lactate dehydrogenase mRNA sequence selected from SEQ ID NOs: 361-432 along at least 15 nucleotides of the second oligonucleotide strand length to reduce lactate dehydrogenase target mRNA expression when the double stranded nucleic acid is introduced into a mammalian cell;

a dsNA comprising a first oligonucleotide strand having a 5' terminus and a 3' terminus and a second oligonucleotide strand having a 5' terminus and a 3' terminus, where each of the 5' termini has a 5' terminal nucleotide and each of the 3' termini has a 3' terminal nucleotide, where the first strand (or the second strand) is 25-30 nucleotide residues in length, where starting from the 5' terminal nucleotide (position 1) positions 1 to 23 of the first strand (or the second strand) include at least 8 ribonucleotides; the second strand (or the first strand) is 36-80 nucleotide residues in length and, starting from the 3' terminal nucleotide, includes at least 8 ribonucleotides in the positions paired with positions 1-23 of the first strand to form a duplex; where at least the 3' terminal nucleotide of the second strand (or the first strand) is unpaired with the first strand (or the second strand), and up to 6 consecutive 3' terminal nucleotides are unpaired with the first strand (or the second strand), thereby forming a 3' single stranded overhang of 1-6 nucleotides; where the 5' terminus of the second strand (or the first strand) includes from 10-30 consecutive nucleotides which are unpaired with the first strand (or the second strand), thereby forming a 10-30 nucleotide single stranded 5' overhang; where at least the first strand (or the second strand) 5' terminal and 3' terminal nucleotides are base paired with nucleotides of the second strand (or first strand) when the first and second strands are aligned for maximum complementarity, thereby forming a substantially duplexed region between the first and second strands; and the second strand is sufficiently complementary to a target RNA along at least 19 ribonucleotides of the second strand length to reduce target gene expression when the double stranded nucleic acid is introduced into a mammalian cell;

a dsNA comprising a first oligonucleotide strand having a 5' terminus and a 3' terminus and a second oligonucleotide strand having a 5' terminus and a 3' terminus, where each of the 5' termini has a 5' terminal nucleotide and each of the 3' termini has a 3' terminal nucleotide, where the first strand is 25-35 nucleotide residues in length, where starting from the 5' terminal nucleotide (position 1) positions 1 to 25 of the second strand include at least 8 ribonucleotides; the second strand is 30-80 nucleotide residues in length and, starting from the 3' terminal nucleotide, comprises at least 8 ribonucleotides in the positions paired with positions 1-25 of the first strand to form a duplex; where the 5' terminus of the second strand comprises from 5-35 consecutive nucleotides which are unpaired with the first strand, thereby forming a 5-35 nucleotide single stranded 5' overhang; where at least the first strand 5' terminal and 3' terminal nucleotides are base paired with nucleotides of the second strand when the first and second strands are aligned for maximum complementarity, thereby forming a substantially duplexed region between the first and second strands; and the second strand is sufficiently complementary to a target lactate dehydrogenase mRNA sequence selected from SEQ ID NOs: 361-432 along at least 15 nucleotides of the second oligonucleotide strand length to reduce lactate dehydrogenase target mRNA expression when the double stranded nucleic acid is introduced into a mammalian cell;

a dsNA comprising a first oligonucleotide strand having a 5' terminus and a 3' terminus and a second oligonucleotide strand having a 5' terminus and a 3' terminus, where each of the 5' termini has a 5' terminal nucleotide and each of the 3' termini has a 3' terminal nucleotide, where the second strand is 19-30 nucleotide residues in length and optionally 25-30 nucleotide residues in length, where starting from the 5' terminal nucleotide (position 1) positions 1 to 17 (optionally positions 1 to 23) of the second strand include at least 8 ribonucleotides; the first strand is 24-80 nucleotide residues in length (optionally 30-80 nucleotide residues in length) and, starting from the 3' terminal nucleotide, comprises at least 8 ribonucleotides in the positions paired with positions 1 to 17 (optionally positions 1 to 23) of the second strand to form a duplex; where the 3' terminus of the first strand and the 5' terminus of the second strand form a blunt end, a 3' overhang or a 5' overhang, optionally where the overhang is 1-6 nucleotides in length; where the 5' terminus of the first strand comprises from 5-35 consecutive nucleotides which are unpaired with the second strand, thereby forming a 5-35 nucleotide single-stranded 5' overhang; where at least the second strand 5' terminal and 3' terminal nucleotides are base paired with nucleotides of the first strand when the first and second strands are aligned for maximum complementarity, thereby forming a substantially duplexed region between the first and second strands; and the second strand is sufficiently complementary to a target lactate dehydrogenase mRNA sequence selected from SEQ ID NOs: 361-432 along at least 15 nucleotides of the second oligonucleotide strand length to reduce lactate dehydrogenase target mRNA expression when the double stranded nucleic acid is introduced into a mammalian cell;

a dsNA comprising a first strand and a second strand, where the first strand and the second strand form a duplex region of 19-25 nucleotides in length, where the first strand comprises a 3' region that extends beyond the first strand-second strand duplex region and comprises a tetraloop, and the dsNA further comprises a discontinuity between the 3' terminus of the first strand and the 5' terminus of the second strand, and the first or second strand is sufficiently complementary to a target lactate dehydrogenase mRNA sequence selected from SEQ ID NOs: 361-432 along at least 15 nucleotides of the first or second strand length to reduce lactate dehydrogenase target mRNA expression when the dsNA is introduced into a mammalian cell; or a dsNA comprising a first oligonucleotide strand having a 5' terminus and a 3' terminus and a second oligonucleotide strand having a 5' terminus and a 3' terminus, where each of the 5' termini has a 5' terminal nucleotide and each of the 3' termini has a 3' terminal nucleotide, where the first oligonucleotide strand is 25-53 nucleotides in length and the second is oligonucleotide strand is 25-53 nucleotides in length, and where the dsNA is sufficiently highly modified to substantially prevent dicer cleavage of the dsNA, optionally where the dsNA is cleaved by non-dicer nucleases to yield one or more 19-23 nucleotide strand length dsNAs capable of reducing LDH mRNA expression in a mammalian cell.

A further aspect of the invention provides an in vivo hybridization complex within a cell that includes an exogenous nucleic acid sequence and a target Lactate Dehydrogenase mRNA sequence of SEQ ID NOs: 361-432.

An additional aspect of the invention provides an in vitro hybridization complex within a cell that includes an exogenous nucleic acid sequence and a target Lactate Dehydrogenase mRNA sequence of SEQ ID NOs: 361-432.

In one embodiment, the dsNA has a duplex region that is 19-21 base pairs, 21-25 base pairs or at least 25 base pairs in length.

In another embodiment, the second oligonucleotide strand includes 1-5 single-stranded nucleotides at its 3' terminus.

In an additional embodiment, the first strand is 25-35 nucleotides in length. Optionally, the second strand is 25-35 nucleotides in length.

In another embodiment, the second oligonucleotide strand is complementary to target lactate dehydrogenase cDNA sequence GenBank Accession No. NM_005566.3 along at most 27 nucleotides of the second oligonucleotide strand length.

In one embodiment, the dsNA or hybridization complex comprises a modified nucleotide. Optionally, the modified nucleotide residue is of the group consisting of 2'-O-methyl, 2'-methoxyethoxy, 2'-fluoro, 2'-allyl, 2'-O-[2-(methylamino)-2-oxoethyl], 4'-thio, 4'-CH2-O-2'-bridge, 4'-(CH2)2-O-2'-bridge, 2'-LNA, 2'-amino and 2'-O—(N-methylcarbamate).

In a further embodiment, starting from the first nucleotide (position 1) at the 3' terminus of the first oligonucleotide strand, position 1, 2 or 3 is substituted with a modified nucleotide. Optionally, the modified nucleotide residue of the 3' terminus of the first strand is a deoxyribonucleotide, an acyclonucleotide or a fluorescent molecule. In certain embodiments, position 1 of the 3' terminus of the first oligonucleotide strand is a deoxyribonucleotide.

In one embodiment, the first strand is 25 nucleotides in length and the second strand is 27 nucleotides in length. Optionally, the 3' terminus of the first strand and the 5' terminus of the second strand form a blunt end.

In another embodiment, starting from the 5' end of a lactate dehydrogenase mRNA sequence of SEQ ID NOs: 361-432 (position 1), mammalian Ago2 cleaves the mRNA at a site between positions 9 and 10 of the sequence, thereby reducing lactate dehydrogenase target mRNA expression when the dsNA is introduced into a mammalian cell. Optionally, the second strand includes a sequence of SEQ ID NOs: 73-144. In certain embodiments, the first strand includes a sequence of SEQ ID NOs: 1-72.

In one embodiment, the dsNA includes a pair of first strand/second strand sequences of Table 2.

In a further embodiment, each of the first and the second strands has a length which is at least 26 nucleotides.

In one embodiment, nucleotides of the 1-5 single-stranded nucleotides of the 3' terminus of the second strand include a modified nucleotide. Optionally, the modified nucleotide is a 2'-O-methyl ribonucleotide. In a related embodiment, all nucleotides of the 1-5 single-stranded nucleotides of the 3' terminus of the second strand are modified nucleotides. In certain embodiments, the 1-5 single-stranded nucleotides of the 3' terminus of the second strand are 1-4 nucleotides in length, are 1-3 nucleotides in length, or are 1-2 nucleotides in length. In a related embodiment, the 1-5 single-stranded nucleotides of the 3' terminus of the second strand is two nucleotides in length and includes a 2'-O-methyl modified ribonucleotide.

In one embodiment, the dsNA has a second strand possessing 5-35 nucleotides at its 3' terminus. Optionally, the single-stranded nucleotides include modified nucleotides. In certain embodiments, the modified nucleotide(s) are 2'-O-methyl, 2'-methoxyethoxy, 2'-fluoro, 2'-allyl, 2'-O-[2-(methylamino)-2-oxoethyl], 4'-thio, 4'-CH2-O-2'-bridge, 4'-(CH2)2-O-2'-bridge, 2'-LNA, 2'-amino and/or 2'-O—(N-methlycarbamate) modified nucleotides. In one embodiment, the single-stranded nucleotides include ribonucleotides. Optionally, the single-stranded nucleotides include deoxyribonucleotides.

In some embodiments, the agent, nucleic acid, dsNA or hybridization complex of the invention also reduces mRNA expression of LDHB and/or LDHC.

In another embodiment, the nucleic acid or dsNA of the invention reduces LDHA mRNA expression but does not reduce mRNA expression of LDHB or LDHC in the subject.

In certain embodiments, the second oligonucleotide strand includes a modification pattern of AS-M1 to AS-M84, AS-M88 to AS-M96, AS-M210, AS-M1* to AS-M84*, AS-M88* to AS-M96* or AS-M210*.

Optionally, the first oligonucleotide strand includes a modification pattern of SM1 to SM119 or SM250 to SM252.

In a further embodiment, each of the first and the second strands has a length which is at least 26 and at most 30 nucleotides.

Optionally, the dsNA is cleaved endogenously in the cell by Dicer.

In certain embodiments, a dsNA of the invention includes at least one unlocked nucleobase analog (UNA). Optionally, the at least one UNA is located in a 3'-overhang region, a 5'-overhang region, or both such regions of the dsNA, optionally on the guide strand of the dsNA.

In some embodiments, a dsNA of the invention is attached to a dynamic polyconjugate (DPC). In additional embodiments, a dsNA of the invention is administered with a DPC, where optionally the dsNA and DPC are not attached.

In some embodiments, a dsNA of the invention is attached to a GalNAc moiety (optionally, a tri-antennary or other multi-GalNAc moiety) and/or to cholesterol or a cholesterol targeting ligand.

In certain embodiments, the amount of the agent, nucleic acid, dsNA or hybridization complex of the invention sufficient to reduce expression of the target gene is 1 nanomolar or less, 200 picomolar or less, 100 picomolar or less, 50 picomolar or less, 20 picomolar or less, 10 picomolar or less, 5 picomolar or less, 2, picomolar or less or 1 picomolar or less in the environment of the cell.

In one embodiment, the agent, nucleic acid, dsNA or hybridization complex possesses greater potency than a 21mer siRNA directed to the identical at least 15 or 19 nucleotides of the target lactate dehydrogenase mRNA in reducing target lactate dehydrogenase mRNA expression when assayed in vitro in a mammalian cell at an effective concentration in the environment of a cell of 1 nanomolar or less. In certain embodiments, knockdown efficacy and/or potency is measured at a concentration of 1 nanomolar, 200 picomolar, 100 picomolar, 50 picomolar, 20 picomolar, 10 picomolar, 5 picomolar, 2, picomolar or 1 picomolar in the environment of a cell.

In another embodiment, the agent, nucleic acid, dsNA or hybridization complex is sufficiently complementary to the target lactate dehydrogenase mRNA sequence to reduce lactate dehydrogenase target mRNA expression by an amount (expressed by %) that is at least 10%, at least 50%, at least 80-90%, at least 95%, at least 98%, or at least 99% when the agent, nucleic acid, dsNA or hybridization complex is introduced into a mammalian cell.

In certain embodiments, the first and second strands are joined by a chemical linker. Optionally, the 3' terminus of the first strand and the 5' terminus of the second strand are joined by a chemical linker.

In one embodiment, a nucleotide of the second or first strand is substituted with a modified nucleotide that directs the orientation of Dicer cleavage.

Optionally, the agent, nucleic acid, dsNA or hybridization complex includes a deoxyribonucleotide, a dideoxyribonucleotide, an acyclonucleotide, a 3'-deoxyadenosine (cordycepin), a 3'-azido-3'-deoxythymidine (AZT), a 2',3'-dideoxyinosine (ddI), a 2',3'-dideoxy-3'-thiacytidine (3TC), a 2',3'-didehydro-2',3'-dideoxythymidine (d4T), a monophosphate nucleotide of 3'-azido-3'-deoxythymidine (AZT), a 2',3'-dideoxy-3'-thiacytidine (3TC) and a monophosphate nucleotide of 2',3'-didehydro-2',3'-dideoxythymidine (d4T), a 4-thiouracil, a 5-bromouracil, a 5-iodouracil, a 5-(3-aminoallyl)-uracil, a 2'-O-alkyl ribonucleotide, a 2'-O-methyl ribonucleotide, a 2'-amino ribonucleotide, a 2'-fluoro ribonucleotide, or a locked nucleic acid.

In certain embodiments, the agent, nucleic acid, dsNA or hybridization complex includes a phosphate backbone modification that is a phosphonate, a phosphorothioate or a phosphotriester.

In one embodiment, the agent, nucleic acid, dsNA or hybridization complex includes a morpholino nucleic acid or a peptide nucleic acid (PNA).

In another embodiment, the agent, nucleic acid, dsNA or hybridization complex comprises a sequence of 15 or 19 consecutive nucleotides that includes four or fewer mismatched nucleotide residues when the 15 or 19 consecutive nucleotides are aligned for maximum complementarity with the target lactate dehydrogenase mRNA sequence.

Optionally, the 15 or 19 consecutive nucleotides include three or fewer mismatched nucleotide residues when the 15 or 19 consecutive nucleotides are aligned for maximum complementarity with the target lactate dehydrogenase mRNA sequence. In certain embodiments, the 15 or 19 consecutive nucleotides include two or fewer mismatched nucleotide residues when the 15 or 19 consecutive nucleotides are aligned for maximum complementarity with the target lactate dehydrogenase mRNA sequence. In related embodiments, the 15 or 19 consecutive nucleotides include one mismatched nucleotide residue when the 15 or 19 consecutive nucleotides are aligned for maximum complementarity with the target lactate dehydrogenase mRNA sequence. In additional embodiments, the 15 or 19 consecutive nucleotides are perfectly complementary to the target lactate dehydrogenase mRNA sequence when the 15 or 19 consecutive nucleotides are aligned for maximum complementarity with the target lactate dehydrogenase mRNA sequence.

In one aspect, the invention provides a method for reducing expression of a target lactate dehydrogenase gene in a mammalian cell involving contacting a mammalian cell in vitro with an agent, nucleic acid, dsNA or hybridization complex of the invention in an amount sufficient to reduce expression of a target lactate dehydrogenase mRNA in the cell.

In one embodiment, target lactate dehydrogenase mRNA expression is reduced by at least 10%, at least 50% or at least 80-90%. Optionally, lactate dehydrogenase mRNA levels are reduced by at least 90% at least 8 days after the cell is contacted with the agent, nucleic acid, dsNA or hybridization complex. In certain embodiments, lactate dehydrogenase mRNA levels are reduced by at least 70% at least 10 days after the cell is contacted with the agent, nucleic acid, dsNA or hybridization complex.

In one aspect, the invention provides a method for reducing expression of a target lactate dehydrogenase mRNA in a mammal involving administering an agent, nucleic acid, dsNA or hybridization complex of the invention to a mammal in an amount sufficient to reduce expression of a target lactate dehydrogenase mRNA in the mammal.

In certain embodiments, the agent, nucleic acid, dsNA or hybridization complex is formulated in a lipid nanoparticle (LNP). In one embodiment, the agent, nucleic acid, dsNA or hybridization complex is administered at a dosage that is 1 microgram to 5 milligrams per kilogram of the mammal per day, 100 micrograms to 0.5 milligrams per kilogram, 0.001 to 0.25 milligrams per kilogram, 0.01 to 20 micrograms per kilogram, 0.01 to 10 micrograms per kilogram, 0.10 to 5 micrograms per kilogram, or 0.1 to 2.5 micrograms per kilogram.

In certain embodiments, the agent, nucleic acid, dsNA or hybridization complex possesses greater potency than 21mer siRNAs directed to the identical at least 19 nucleotides of the target lactate dehydrogenase mRNA in reducing target lactate dehydrogenase mRNA expression when assayed in vitro in a mammalian cell at an effective concentration in the environment of a cell of 1 nanomolar or less. In certain embodiments, knockdown efficacy and/or potency is measured at a concentration of 1 nanomolar, 200 picomolar, 100 picomolar, 50 picomolar, 20 picomolar, 10 picomolar, 5 picomolar, 2, picomolar or 1 picomolar in the environment of a cell.

In another embodiment, lactate dehydrogenase mRNA levels are reduced in a tissue of the mammal by at least 70% at least 3 days after the agent, nucleic acid, dsNA or hybridization complex is administered to the mammal. Optionally, the tissue is liver tissue.

In certain embodiments, administering includes intravenous injection, intramuscular injection, intraperitoneal injection, infusion, subcutaneous injection, transdermal, aerosol, rectal, vaginal, topical, oral or inhaled delivery.

In another aspect, the invention provides a method for treating or preventing PH1 in a subject that involves administering an agent, nucleic acid, dsNA or hybridization complex of the invention to the subject in an amount sufficient to treat or prevent PH1 in the subject.

An additional aspect of the invention provides a method for treating or preventing primary hyperoxaluria type 2 (PH2) in a subject involving administering to the subject an amount of an agent, nucleic acid, dsNA or hybridization complex of the invention in an amount sufficient to treat or prevent PH2 in the subject.

Another aspect of the invention provides a method for treating or preventing primary hyperoxaluria type 3 (PH3) in a subject comprising administering to the subject an amount of an agent, nucleic acid, dsNA or hybridization complex of the invention in an amount sufficient to treat or prevent PH3 in the subject.

A further aspect of the invention provides a method for treating or preventing idiopathic hyperoxaluria in a subject comprising administering to the subject an amount of an agent, nucleic acid, dsNA or hybridization complex of the invention in an amount sufficient to treat or prevent idiopathic hyperoxaluria in the subject.

Another aspect of the invention provides a method for treating or preventing cancer in a subject comprising administering to the subject an amount of an agent, nucleic acid, dsNA or hybridization complex of the invention in an amount sufficient to treat or prevent cancer in the subject.

An additional aspect of the invention provides a method for treating or preventing chronic kidney disease or pyruvate dehydrogenase complex deficiency in a subject involving administering to the subject an amount of an agent, nucleic acid, dsNA or hybridization complex of the invention in an amount sufficient to treat or prevent chronic kidney disease or pyruvate dehydrogenase deficiency in the subject.

In one embodiment, the subject is human.

In certain embodiments, the method further involves administering an inhibitor of LDHB and/or LDHC. Optionally, the inhibitor of LDHB and/or LDHC is a dsNA (optionally a siRNA or a DsiRNA).

In a further aspect, the invention provides a formulation containing an agent, nucleic acid, dsNA or hybridization complex of the invention present in an amount effective to reduce target lactate dehydrogenase mRNA levels when the agent, nucleic acid, dsNA or hybridization complex is introduced into a mammalian cell in vitro by at least 10%, at least 50% or at least 80-90%.

In one embodiment, the effective amount is 1 nanomolar or less, 200 picomolar or less, 100 picomolar or less, 50 picomolar or less, 20 picomolar or less, 10 picomolar or less, 5 picomolar or less, 2, picomolar or less or 1 picomolar or less in the environment of the cell. In certain embodiments, knockdown efficacy is measured at a concentration of 1 nanomolar, 200 picomolar, 100 picomolar, 50 picomolar, 20 picomolar, 10 picomolar, 5 picomolar, 2, picomolar or 1 picomolar in the environment of a cell.

In another aspect, the invention provides a formulation including the agent, nucleic acid, dsNA or hybridization complex of the invention present in an amount effective to reduce target lactate dehydrogenase mRNA levels when the agent, nucleic acid, dsNA or hybridization complex is introduced into a cell of a mammalian subject by at least 10%, at least 50% or at least 80-90%. Optionally, the effective amount is a dosage of 1 microgram to 5 milligrams per kilogram of the subject per day, 100 micrograms to 0.5 milligrams per kilogram, 0.001 to 0.25 milligrams per kilogram, 0.01 to 20 micrograms per kilogram, 0.01 to 10 micrograms per kilogram, 0.10 to 5 micrograms per kilogram, or 0.1 to 2.5 micrograms per kilogram.

In certain embodiments, the formulation includes a lipid nanoparticle. Optionally, the formulation preferentially targets liver and/or neoplasia tissues. In another embodiment, the formulation preferentially targets muscle cells.

In an additional aspect, the invention provides a mammalian cell containing an agent, nucleic acid, dsNA or hybridization complex of the invention.

In a further aspect, the invention provides a pharmaceutical composition containing an agent, nucleic acid, dsNA or hybridization complex of the invention and a pharmaceutically acceptable carrier. In one embodiment, the pharmaceutical composition further includes an LDHB and/or LDHC inhibitor (e.g., a dsNA inhibitor of LDHB and/or LDHC).

In another aspect, the invention provides a kit that includes an agent, nucleic acid, dsNA or hybridization complex of the invention and instructions for its use.

In an additional aspect, the invention provides a composition possessing lactate dehydrogenase inhibitory activity that consists essentially of an agent, nucleic acid, dsNA or hybridization complex of the invention.

Another aspect of the invention provides a method of hybridizing an exogenous agent, nucleic acid, dsNA or hybridization complex to mRNA in a cell that involves introducing into the cell an exogenous agent, nucleic acid, dsNA or hybridization complex sequence and hybridizing the exogenous agent, nucleic acid, dsNA or hybridization complex to a target Lactate Dehydrogenase mRNA sequence that is a sequence of SEQ ID NOs: 361-432.

A further aspect of the invention provides a method of treating an individual with a liver or lung disease or disorder that involves introducing into cells of the individual an exogenous agent, nucleic acid, dsNA or hybridization complex and hybridizing the exogenous agent, nucleic acid, dsNA or hybridization complex to a target Lactate Dehydrogenase mRNA sequence of SEQ ID NOs: 361-432.

An additional aspect of the invention provides a method of forming an in vivo hybridization complex within a cell that involves introducing into the cell an exogenous agent, nucleic acid, dsNA or hybridization complex and hybridizing the exogenous agent, nucleic acid, dsNA or hybridization complex to a target Lactate Dehydrogenase mRNA sequence of SEQ ID NOs: 361-432.

A further aspect of the invention provides a method of inhibiting translation of a target mRNA into a protein within a cell that involves introducing into the cell an exogenous agent, nucleic acid, dsNA or hybridization complex and hybridizing the exogenous agent, nucleic acid, dsNA or hybridization complex to a target Lactate Dehydrogenase mRNA sequence of SEQ ID NOs: 361-432, complexing the exogenous agent, nucleic acid, dsNA or hybridization complex with RISC, and cleaving the mRNA.

In one embodiment, the exogenous agent, nucleic acid, dsNA or hybridization complex is complexed with RISC. In a related embodiment, the RISC cleaves the mRNA.

A further aspect of the invention provides a dsNA having a first strand and a second strand, where the first strand is between 32 and 80 nucleic acid residues in length and possesses a tetraloop, and a second strand of 19 to 30 nucleotides in length that anneals to the first strand to form a duplex, where the second oligonucleotide strand is sufficiently complementary to a target lactate dehydrogenase mRNA sequence of SEQ ID NOs: 361-432 along at least 15 nucleotides of the oligonucleotide strand length to reduce lactate dehydrogenase target mRNA expression when the dsNA is introduced into a mammalian cell.

In one embodiment, the pairs of first strand and second strand sequences are SEQ ID NOs: 7190 and 7191; SEQ ID NOs: 7192 and 7193; SEQ ID NOs: 7196 and 7197; SEQ ID NOs: 7198 and 7199; SEQ ID NOs: 7200 and 7201; SEQ ID NOs: 7202 and 7203; SEQ ID NOs: 7204 and 7205; SEQ ID NOs: 7206 and 7207; SEQ ID NOs: 7208 and 7209; SEQ ID NOs: 7210 and 7211; or SEQ ID NOs: 7212 and 7213.

Optionally, the dsNA is LNP-formulated and/or conjugated to GalNAc,

The invention also provides a method for treating a lactate dehydrogenase knockdown-treatable disease or disorder in a subject that involves administering to a subject having a lactate dehydrogenase knockdown-treatable disease or disorder a tetraloop-containing dsNA, where the administering reduces expression of the LDHA gene in one or more tissues of the subject, thereby treating the lactate dehydrogenase knockdown-treatable disease or disorder in the subject.

In one embodiment, the lactate dehydrogenase knockdown-treatable disease or disorder is a neoplasia, optionally a liver and/or pancreatic tumor(s).

BRIEF DESCRIPTION OF THE DRAWINGS

FIGS. 3A to 3J present primary screen data showing DsiRNA-mediated knockdown of human lactate dehydrogenase (FIGS. 3A to 3D), mouse lactate dehydrogenase (FIG. 3E to 3H), or a composite of both human and mouse lactate dehydrogenase knockdown data (FIGS. 3I and 3J), in human (HeLa) and mouse (B16-F10) cells, respectively. For each DsiRNA tested, two independent qPCR amplicons were assayed (in human cells, amplicons "262-396" and "1304-1419" were assayed, while in mouse cells, amplicons "384-510" and "1402-1504" were assayed).

FIG. 4B demonstrates the duration of the LDH knockdown effect observed for both mRNA and protein expression (using LDHA-718-M24/M527 (DP2685P:DP2692G) in 2185 LNP, 1 mg/kg, single dose, intravenous injection). FIG. 4C shows the specificity of knockdown effects for LDHA, PRODH2 and HAO1, in both mRNA expression levels and protein levels.

FIGS. 5A through 5D show that intravenous injection of LDHA-targeting DsiRNA also reduced oxalate excretion in PH1 model mice (mice pre-treated with AGXT DsiRNA to simulate PH1), as compared to PBS-injected control PH1 model mice, and even as compared to PH1 model mice administered DsiRNA targeting oxalate metabolism pathway components glycolate oxidase (HAO1) or PRODH2 (proline dehydrogenase (oxidase) 2; see FIG. 6). In FIGS. 5A through 5D, mice (n=5/group) were injected on day 0 and day 14 (and on additional days as indicated in the extended studies presented in FIGS. 5B and 5D) with AGXT-targeting DsiRNA (upper arrows of each series), then subjected to intravenous injection of PBS (upper left), anti-PRODH2 DsiRNA (upper right), anti-HAO1 DsiRNA (lower left) or anti-LDHA DsiRNA (lower right), respectively, at days 3, 10, 17 and 24 (and additional dates as shown for results presented in FIGS. 5B and 5D). Oxalate excretion was measured at days 0, 7 and 14 for PBS-treated PH1 model mice, while levels of oxalate excretion were assayed in DsiRNA-treated mice at days −4, 7, 14, 21 and 28 (and at indicated extended dates in FIGS. 5B and 5D). Both PBS- and PRODH2 DsiRNA-treated groups of mice were observed to exhibit dramatically elevated oxalate excretion levels when assayed at day 7 post-AGXT DsiRNA injection. PRODH2 DsiRNA-treated groups of mice were also observed to exhibit further elevated oxalate excretion levels when assayed at day 21 post-initial AGXT DsiRNA injection (while PBS-treated mice were only maintained until day 14). HAO1 DsiRNA-treated groups of mice were also observed to exhibit elevated oxalate excretion levels when assayed at day 7 or day 21 post-initial AGXT DsiRNA injection, though the levels of such elevations appeared to be reduced as compared to PBS-treated or PRODH2 DsiRNA-treated PH1 model mice, and ultimately appeared to converge with anti-LDHA-treated mice at extended timepoints. Remarkably, treatment of PH1 model mice with an LDHA-targeting DsiRNA under the same injection schedule revealed dramatic inhibitions of oxalate elevation at both day 7 and day 21 post-initial AGXT DsiRNA injection, as well as at extended timepoints, where assessed (e.g., FIGS. 5B and 5D). Thus, reduced levels of LDHA mRNA and protein (as demonstrated in FIGS. 4A to 4C above) also translated into phenotypic effects in inhibiting elevation of oxalate excretion in PH1 model mice. FIGS. 5C and 5D show that all DsiRNAs tested in PH1 model mice (PRODH2-, HAO1- and LDHA-targeting DsiRNAs) showed at least some inhibitory impact upon oxalate concentration (left pane of FIG. 5C); however, LDHA-targeting DsiRNA demonstrated the greatest reduction of oxalate excretion, even as compared to HAO1-targeting DsiRNA.

In FIG. 5E, LDHA-718-M24/M527 (DP2685P:DP2692G) in 2185 LNP in Male Agxt$^{-/-}$ mice challenged with ethylene glycol (a PH1 model) was observed to reduce urine oxalate levels, when urine samples were collected using metabolic cages except on day 27, which was collected manually, and kidneys were harvested at day 27 for calcium oxalate analysis. In FIG. 5F, administration of LDHA DsiRNA LDHA-718-M24/M527 (DP2685P:DP2692G) in 2185 LNP was observed to prevent ethylene glycol-induced kidney damage in Agxt$^{-/-}$ mice (0.7% EG was supplied with drinking water to all mice were treated with LDHA DsiRNA 1 (Early Treatment) or 3 weeks (Late Treatment) after EG fed). In FIG. 5G, administration of LDHA DsiRNA LDHA-718-M24/M527 (DP2685P:DP2692G) in 2185 LNP was also observed to prevent ethylene glycol-induced calcium oxalate crystals in Agxt$^{-/-}$ mice (0.7% EG was supplied with drinking water to all mice were treated with LDHA DsiRNA 1 (Early Treatment) or 3 weeks (Late Treatment) after EG fed), where half of each kidney was processed per animal, and 2 sections from each half were scored. All counting in FIG. 5G was performed manually, with crystals/staining visible at a 10× magnification counted.

In FIG. 7A, the M575/M492, M576/M491 and M582/M492 modification patterns present SEQ ID Nos: 7187 (tetraloop-possessing first strand sequence) and 7188 (second strand), with varying modification patterns across such sequences, as indicated. The M583/M494 structure in FIG. 7A presents SEQ ID Nos: 7187 (tetraloop-possessing first strand sequence) and 7189 (second strand, contains deoxynucleotides, where indicated). FIG. 7B shows histograms of % LDHA knockdown across various forms of modified tetraloop constructs, as indicated. FIG. 7C presents dose-response curves and IC$_{50}$ values for indicated modified forms of tetraloop-possessing constructs LDHA-723-M576/M491 (tetraloop-containing strand sequence is SEQ ID NO: 7190 and guide/antisense (lower) strand is SEQ ID NO: 7191), LDHA-1360-M576/M491 and LDHA-1360-M582/M492 (tetraloop-containing strand sequence for LDHA-1360 structures is SEQ ID NO: 7192 and guide/antisense (lower) strand is SEQ ID NO: 7193).

FIG. 8A shows the conversion of 25/27mer modification patterns into tetraloop-possessing agents that was performed. Sequences of 25/27mers are represented by SEQ ID NOs: 7194 and 7195, with the various modification patterns shown made to such sequences. Tetraloop-possessing sequences in FIGS. 8A to 8E correspond to SEQ ID NOs: 7187 and 7188. FIG. 8B to 8E show histograms of knockdown data obtained for all indicated tetraloop agents in vitro. Certain duplex sequences were selected for scale-up and additional testing.

In FIG. 9A, the oligonucleotides of LDHA-723-M576/M491 correspond to SEQ ID NOs: 7190 and 7191.

FIGS. 10A and 10B show that LNP-formulated LDHA-718-M571/M550 possessed high levels of anti-tumor efficacy (TGI of 78%; FIG. 10A) and also produced >75% knockdown of LDHA in Hep3B tumors of treated animals, on average (FIG. 10B), after a single round of dosing with the LNP/LDHA-718-M571/M550 DsiRNA.

DETAILED DESCRIPTION OF THE INVENTION

Figure 1:
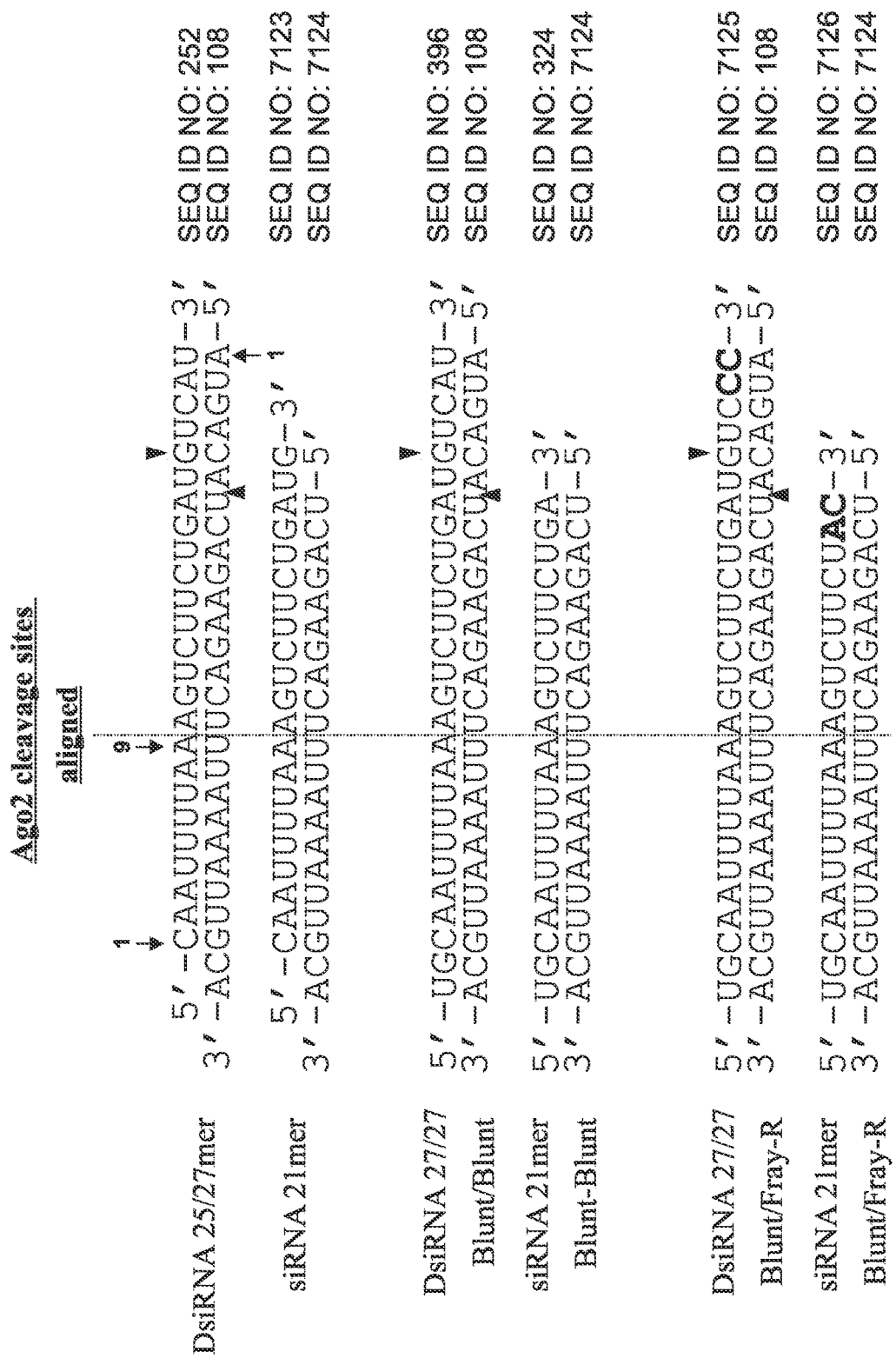
FIG. 1 shows the structures of exemplary DsiRNA agents of the invention targeting a site in the lactate dehydrogenase RNA referred to herein as the "lactate dehydrogenase-1287" or "LDHA-1287" target site. UPPER case=unmodified RNA, lower case=DNA, Bold=mismatch base pair nucleotides; arrowheads indicate projected Dicer enzyme cleavage sites; dashed line indicates sense strand (top strand) sequences corresponding to the projected Argonaute 2 (Ago2) cleavage site within the targeted lactate dehydrogenase sequence.

The present invention is directed to methods and agents that reduce and/or inhibit the expression and/or levels of LDHA in a cell, tissue and/or subject. Modes of delivery and/or LDHA inhibitory agents that are capable of being delivered in a manner that tends not to deliver to muscle and/or other tissue(s) in which LDHA inhibition might be deleterious in at least certain individuals are identified and described herein. Certain agents of the invention knock down expression of the LDHA transcript, in certain embodiments for therapeutic purpose. LDHA is identified herein as a therapeutic target for treatment of chronic kidney disease, pyruvate dehydrogenase complex deficiency, or for treatment of PH1 and/or any other lactate dehydrogenase-associated disease or disorder, including, e.g., PH2, PH3 and idiopathic hyperoxaluria, as well as oncology. In certain embodiments, the invention provides compositions that contain nucleic acids, for example double stranded NA ("dsNA"), and methods for preparing them, that are capable of reducing the level and/or expression of the lactate dehydrogenase gene in vivo or in vitro. In some embodiments, such dsNA molecules are substrates of the Dicer enzyme, having double-stranded duplex regions of approximately 25 or more nucleotides in length, optionally possessing extended single-stranded 5' overhang regions on either the guide or passenger strand of the Dicer substrate dsNA. In certain embodiments, a dsNA of the invention can have first and second strands of a duplex joined by a nucleotide linker—optionally, such a linker includes a tetraloop. In related embodiments, one of the strands of the dsRNA contains a region of nucleotide sequence that has a length that ranges from 19 to 35 nucleotides that can direct the destruction and/or translational inhibition of the targeted lactate dehydrogenase transcript. Optionally, a dsNA of the invention is modified, for example with 2'-O-methyl modifications and/or GalNAc moieties.

Definitions

Unless defined otherwise, all technical and scientific terms used herein have the meaning commonly understood by a person skilled in the art to which this invention belongs. The following references provide one of skill with a general definition of many of the terms used in this invention: Singleton et al., Dictionary of Microbiology and Molecular Biology (2nd ed. 1994); The Cambridge Dictionary of Science and Technology (Walker ed., 1988); The Glossary of Genetics, 5th Ed., R. Rieger et al. (eds.), Springer Verlag (1991); and Hale & Marham, The Harper Collins Dictionary of Biology (1991). As used herein, the following terms have the meanings ascribed to them below, unless specified otherwise.

The present invention features one or more DsiRNA molecules that can modulate (e.g., inhibit) lactate dehydrogenase expression. The DsiRNAs of the invention optionally can be used in combination with modulators of other genes and/or gene products associated with the maintenance or development of diseases or disorders associated with lactate dehydrogenase misregulation (e.g., oxalate accumulation, PH1, chronic kidney disease, pyruvate dehydrogenase complex deficiency, etc.). The DsiRNA agents of the invention modulate lactate dehydrogenase RNAs such as those corresponding to the cDNA sequences referred to by GenBank Accession Nos. NM_005566.3 (human lactate dehydrogenase A) and NM_001136069.2 (mouse lactate dehydrogenase A), which are referred to herein generally as "lactate dehydrogenase."

The below description of the various aspects and embodiments of the invention is provided with reference to exemplary lactate dehydrogenase RNAs, generally referred to herein as lactate dehydrogenase, LDH or LDHA (for the "A" isoform most prominently targeted). However, such reference is meant to be exemplary only and the various aspects and embodiments of the invention are also directed to alternate lactate dehydrogenase RNAs, such as mutant lactate dehydrogenase RNAs or additional lactate dehydrogenase splice variants. Certain aspects and embodiments are also directed to other genes involved in lactate dehydrogenase pathways, including genes whose misregulation acts in association with that of lactate dehydrogenase (or is affected or affects lactate dehydrogenase regulation) to produce phenotypic effects that may be targeted for treatment (e.g., PH1, chronic kidney disease, pyruvate dehydrogenase complex deficiency, etc.). See, e.g., the enzymes of FIG. 2. Such additional genes, including those of pathways that act in coordination with lactate dehydrogenase, can be targeted using dsRNA and the methods described herein for use of lactate dehydrogenase-targeting dsRNAs. Thus, the inhibition and the effects of such inhibition of the other genes can be performed as described herein.

The term "lactate dehydrogenase" refers to nucleic acid sequences encoding a lactate dehydrogenase protein, peptide, or polypeptide (e.g., lactate dehydrogenase transcripts, such as the sequences of lactate dehydrogenase Genbank Accession Nos. NM_005566.3 and NM_001136069.2). In certain embodiments, the term "lactate dehydrogenase" is also meant to include other lactate dehydrogenase encoding sequence, such as other lactate dehydrogenase isoforms, mutant lactate dehydrogenase genes, splice variants of lactate dehydrogenase genes, and lactate dehydrogenase gene polymorphisms. The term "lactate dehydrogenase" is also used to refer to the polypeptide gene product of an lactate dehydrogenase gene/transcript, e.g., an lactate dehydrogenase protein, peptide, or polypeptide, such as those encoded by lactate dehydrogenase Genbank Accession Nos. NP_005557.1 and NP_001129541.2.

As used herein, a "lactate dehydrogenase knockdown-treatable disease or disorder" refers to a disease or disorder known in the art to be associated with altered lactate dehydrogenase expression, level and/or activity, or to a disease or disorder such as PH1 in which lactate dehydrogenase knockdown is known or predicted to be therapeutic or otherwise advantageous, or to PH2, PH3 or idiopathic hyperoxaluria, chronic kidney disease, pyruvate dehydrogenase complex deficiency or cancer. Notably, a "lactate dehydrogenase knockdown-treatable disease or disorder" includes PH1, PH2, PH3, idiopathic hyperoxaluria, chronic kidney disease, pyruvate dehydrogenase complex deficiency, cancer and other art recognized diseases or disorders associated with oxalate accumulation.

An anti-lactate dehydrogenase dsRNA of the invention is deemed to possess "lactate dehydrogenase inhibitory activity" if a statistically significant reduction in lactate dehydrogenase RNA (or when the lactate dehydrogenase protein is assessed, lactate dehydrogenase protein levels) is seen when an anti-lactate dehydrogenase dsRNA of the invention is administered to a system (e.g., cell-free in vitro system), cell, tissue or organism, as compared to a selected control. The distribution of experimental values and the number of replicate assays performed will tend to dictate the parameters of what levels of reduction in lactate dehydrogenase RNA (either as a % or in absolute terms) is deemed statistically significant (as assessed by standard methods of determining statistical significance known in the art). However, in certain embodiments, "lactate dehydrogenase inhibitory activity" is defined based upon a % or absolute level of reduction in the level of lactate dehydrogenase in a system, cell, tissue or organism. For example, in certain embodiments, a dsRNA of the invention is deemed to possess lactate dehydrogenase inhibitory activity if at least a 5% reduction or at least a 10% reduction in lactate dehydrogenase RNA is observed in the presence of a dsRNA of the invention relative to lactate dehydrogenase levels seen for a suitable control. (For example, in vivo lactate dehydrogenase levels in a tissue and/or subject can, in certain embodiments, be deemed to be inhibited by a dsRNA agent of the invention if, e.g., a 5% or 10% reduction in lactate dehydrogenase levels is observed relative to a control.) In certain other embodiments, a dsRNA of the invention is deemed to possess lactate dehydrogenase inhibitory activity if lactate dehydrogenase RNA levels are observed to be reduced by at least 15% relative to a selected control, by at least 20% relative to a selected control, by at least 25% relative to a selected control, by at least 30% relative to a selected control, by at least 35% relative to a selected control, by at least 40% relative to a selected control, by at least 45% relative to a selected control, by at least 50% relative to a selected control, by at least 55% relative to a selected control, by at least 60% relative to a selected control, by at least 65% relative to a selected control, by at least 70% relative to a selected control, by at least 75% relative to a selected control, by at least 80% relative to a selected control, by at least 85% relative to a selected control, by at least 90% relative to a selected control, by at least 95% relative to a selected control, by at least 96% relative to a selected control, by at least 97% relative to a selected control, by at least 98% relative to a selected control or by at least 99% relative to a selected control. In some embodiments, complete inhibition of lactate dehydrogenase is required for a dsRNA to be deemed to possess lactate dehydrogenase inhibitory activity. In certain models (e.g., cell culture), a dsRNA is deemed to possess lactate dehydrogenase inhibitory activity if at least a 50% reduction in lactate dehydrogenase levels is observed relative to a suitable control. In certain other embodiments, a dsRNA is deemed to possess lactate dehydrogenase inhibitory activity if at least an 80% reduction in lactate dehydrogenase levels is observed relative to a suitable control.

By way of specific example, in Example 2 below, a series of DsiRNAs targeting lactate dehydrogenase were tested for the ability to reduce lactate dehydrogenase mRNA levels in human HeLa or mouse B16-F10 cells in vitro, at 1 nM concentrations in the environment of such cells and in the presence of a transfection agent (Lipofectamine™ RNAiMAX, Invitrogen). Within Example 2 below, lactate dehydrogenase inhibitory activity was ascribed to those DsiRNAs that were observed to effect at least a 70% reduction of lactate dehydrogenase mRNA levels under the assayed conditions. It is contemplated that lactate dehydrogenase inhibitory activity could also be attributed to a dsRNA under either more or less stringent conditions than those employed for Example 2 below, even when the same or a similar assay and conditions are employed. For example, in certain embodiments, a tested dsRNA of the invention is deemed to possess lactate dehydrogenase inhibitory activity if at least a 10% reduction, at least a 20% reduction, at least a 30% reduction, at least a 40% reduction, at least a 50% reduction, at least a 60% reduction, at least a 75% reduction, at least an 80% reduction, at least an 85% reduction, at least a 90% reduction, or at least a 95% reduction in lactate dehydrogenase mRNA levels is observed in a mammalian cell line in vitro at 1 nM dsRNA concentration or lower in the environment of a cell, relative to a suitable control.

Use of other endpoints for determination of whether a double stranded RNA of the invention possesses lactate dehydrogenase inhibitory activity is also contemplated. Specifically, in one embodiment, in addition to or as an alternative to assessing lactate dehydrogenase mRNA levels, the ability of a tested dsRNA to reduce lactate dehydrogenase protein levels (e.g., at 48 hours after contacting a mammalian cell in vitro or in vivo) is assessed, and a tested dsRNA is deemed to possess lactate dehydrogenase inhibitory activity if at least a 10% reduction, at least a 20% reduction, at least a 30% reduction, at least a 40% reduction, at least a 50% reduction, at least a 60% reduction, at least a 70% reduction, at least a 75% reduction, at least an 80% reduction, at least an 85% reduction, at least a 90% reduction, or at least a 95% reduction in lactate dehydrogenase protein levels is observed in a mammalian cell contacted with the assayed double stranded RNA in vitro or in vivo, relative to a suitable control. Additional endpoints contemplated include, e.g., assessment of a phenotype associated with reduction of lactate dehydrogenase levels—e.g., reduction of oxalate accumulation and/or PH1 phenotypes and/or PH1-associated phenotypes (e.g., kidney diseases or disorders associated with oxalate accumulation), or diseases or disorders of other organs, e.g., muscle, associated with oxalate accumulation.

Lactate Dehydrogenase inhibitory activity can also be evaluated over time (duration) and over concentration ranges (potency), with assessment of what constitutes a dsRNA possessing lactate dehydrogenase inhibitory activity adjusted in accordance with concentrations administered and duration of time following administration. Thus, in certain embodiments, a dsRNA of the invention is deemed to possess lactate dehydrogenase inhibitory activity if at least a 50% reduction in lactate dehydrogenase activity is observed/persists at a duration of time of 2 hours, 5 hours, 10 hours, 1 day, 2 days, 3 days, 4 days, 5 days, 6 days, 7 days, 8 days, 9 days, 10 days or more after administration of the dsRNA to a cell or organism. In additional embodiments, a dsRNA of the invention is deemed to be a potent lactate dehydrogenase inhibitory agent if lactate dehydrogenase inhibitory activity (e.g., in certain embodiments, at least 50% inhibition of lactate dehydrogenase) is observed at a concentration of 1 nM or less, 500 pM or less, 200 pM or less, 100 pM or less, 50 pM or less, 20 pM or less, 10 pM or less, 5 pM or less, 2 pM or less or even 1 pM or less in the environment of a cell, for example, within an in vitro assay for lactate dehydrogenase inhibitory activity as described herein. In certain embodiments, a potent lactate dehydrogenase inhibitory dsRNA of the invention is defined as one that is capable of lactate dehydrogenase inhibitory activity (e.g., in certain embodiments, at least 20% reduction of lactate dehydrogenase levels) at a formulated concentration of 10 mg/kg or less when administered to a subject in an effective delivery vehicle (e.g., an effective lipid nanoparticle formulation). Preferably, a potent lactate dehydrogenase inhibitory dsRNA of the invention is defined as one that is capable of lactate dehydrogenase inhibitory activity (e.g., in certain embodiments, at least 50% reduction of lactate dehydrogenase levels) at a formulated concentration of 5 mg/kg or less when administered to a subject in an effective delivery vehicle. More preferably, a potent lactate dehydrogenase inhibitory dsRNA of the invention is defined as one that is capable of lactate dehydrogenase inhibitory activity (e.g., in certain embodiments, at least 50% reduction of lactate dehydrogenase levels) at a formulated concentration of 5 mg/kg or less when administered to a subject in an effective delivery vehicle. Optionally, a potent lactate dehydrogenase inhibitory dsRNA of the invention is defined as one that is capable of lactate dehydrogenase inhibitory activity (e.g., in certain embodiments, at least 50% reduction of lactate dehydrogenase levels) at a formulated concentration of 2 mg/kg or less, or even 1 mg/kg or less, when administered to a subject in an effective delivery vehicle. Exemplary discrete formulated concentrations of lactate dehydrogenase-targeting RNAi agents of the invention include about 5 mg/kg, about 2 mg/kg, about 1 mg/kg, about 500 µg/kg, about 250 µg/kg, about 100 µg/kg, about 50 µg/kg, about 25 µg/kg, about 10 µg/kg, about 5 µg/kg, about 2.5 µg/kg, about 1 µg/kg, about 500 ng/kg, about 250 ng/kg, about 100 ng/kg, about 50 ng/kg, about 25 ng/kg, about 10 ng/kg, about 5 ng/kg, about 2.5 ng/kg, about 1 ng/kg and about 500 µg/kg.

About: As used herein, the term "about" means+/−10% of the recited value. Use of "about" is contemplated in reference to all ranges and values recited herein.

In certain embodiments, the phrase "consists essentially of" is used in reference to the anti-lactate dehydrogenase dsRNAs of the invention. In some such embodiments, "consists essentially of" refers to a composition that comprises a dsRNA of the invention which possesses at least a certain level of lactate dehydrogenase inhibitory activity (e.g., at least 50% lactate dehydrogenase inhibitory activity) and that also comprises one or more additional components and/or modifications that do not significantly impact the lactate dehydrogenase inhibitory activity of the dsRNA. For example, in certain embodiments, a composition "consists essentially of" a dsRNA of the invention where modifications of the dsRNA of the invention and/or dsRNA-associated components of the composition do not alter the lactate dehydrogenase inhibitory activity (optionally including potency or duration of lactate dehydrogenase inhibitory activity) by greater than 3%, greater than 5%, greater than 10%, greater than 15%, greater than 20%, greater than 25%, greater than 30%, greater than 35%, greater than 40%, greater than 45%, or greater than 50% relative to the dsRNA of the invention in isolation. In certain embodiments, a composition is deemed to consist essentially of a dsRNA of the invention even if more dramatic reduction of lactate dehydrogenase inhibitory activity (e.g., 80% reduction, 90% reduction, etc. in efficacy, duration and/or potency) occurs in the presence of additional components or modifications, yet where lactate dehydrogenase inhibitory activity is not significantly elevated (e.g., observed levels of lactate dehydrogenase inhibitory activity are within 10% those observed for the dsRNA of the invention) in the presence of additional components and/or modifications.

As used herein, the term "nucleic acid" refers to deoxyribonucleotides, ribonucleotides, or modified nucleotides, and polymers thereof in single- or double-stranded form. The term encompasses nucleic acids containing known nucleotide analogs or modified backbone residues or linkages, which are synthetic, naturally occurring, and non-naturally occurring, which have similar binding properties as the reference nucleic acid, and which are metabolized in a manner similar to the reference nucleotides. Examples of such analogs include, without limitation, phosphorothioates, phosphoramidates, methyl phosphonates, chiral-methyl phosphonates, 2-O-methyl ribonucleotides, peptide-nucleic acids (PNAs) and unlocked nucleic acids (UNAs or unlocked nucleobase analogs; see, e.g., Jensen et al. *Nucleic Acids Symposium Series* 52: 133-4), and derivatives thereof.

As used herein, "nucleotide" is used as recognized in the art to include those with natural bases (standard), and modified bases well known in the art. Such bases are generally located at the 1' position of a nucleotide sugar moiety. Nucleotides generally comprise a base, sugar and a phosphate group. The nucleotides can be unmodified or modified at the sugar, phosphate and/or base moiety, (also referred to interchangeably as nucleotide analogs, modified nucleotides, non-natural nucleotides, non-standard nucleotides and other; see, e.g., Usman and McSwiggen, supra; Eckstein, et al., International PCT Publication No. WO 92/07065; Usman et al, International PCT Publication No. WO 93/15187; Uhlman & Peyman, supra, all are hereby incorporated by reference herein). There are several examples of modified nucleic acid bases known in the art as summarized by Limbach, et al, *Nucleic Acids Res.* 22:2183, 1994. Some of the non-limiting examples of base modifications that can be introduced into nucleic acid molecules include, hypoxanthine, purine, pyridin-4-one, pyridin-2-one, phenyl, pseudouracil, 2,4,6-trimethoxy benzene, 3-methyl uracil, dihydrouridine, naphthyl, aminophenyl, 5-alkylcytidines (e.g., 5-methylcytidine), 5-alkyluridines (e.g., ribothymidine), 5-halouridine (e.g., 5-bromouridine) or 6-azapyrimidines or 6-alkylpyrimidines (e.g. 6-methyluridine), propyne, and others (Burgin, et al., Biochemistry 35:14090, 1996; Uhlman & Peyman, supra). By "modified bases" in this aspect is meant nucleotide bases other than adenine, guanine, cytosine and uracil at 1' position or their equivalents.

As used herein, "modified nucleotide" refers to a nucleotide that has one or more modifications to the nucleoside, the nucleobase, pentose ring, or phosphate group. For example, modified nucleotides exclude ribonucleotides containing adenosine monophosphate, guanosine monophosphate, uridine monophosphate, and cytidine monophosphate and deoxyribonucleotides containing deoxyadenosine monophosphate, deoxyguanosine monophosphate, deoxythymidine monophosphate, and deoxycytidine monophosphate. Modifications include those naturally occurring that result from modification by enzymes that modify nucleotides, such as methyltransferases. Modified nucleotides also include synthetic or non-naturally occurring nucleotides. Synthetic or non-naturally occurring modifications in nucleotides include those with 2' modifications, e.g., 2'-methoxyethoxy, 2'-fluoro, 2'-allyl, 2'-O-[2-(methylamino)-2-oxoethyl], 4'-thio, 4'-CH$_2$—O-2'-bridge, 4'-(CH$_2$)$_2$—O-2'-bridge, 2'-LNA or other bicyclic or "bridged" nucleoside analog, and 2'-O—(N-methylcarbamate) or those comprising base analogs. In connection with 2'-modified nucleotides as described for the present disclosure, by "amino" is meant 2'-NH$_2$ or 2'-O—NH$_2$, which can be modified or unmodified. Such modified groups are described, e.g., in Eckstein et al., U.S. Pat. No. 5,672,695 and Matulic-Adamic et al., U.S. Pat. No. 6,248,878. "Modified nucleotides" of the instant invention can also include nucleotide analogs as described above.

In reference to the nucleic acid molecules of the present disclosure, modifications may exist upon these agents in patterns on one or both strands of the double stranded ribonucleic acid (dsRNA). As used herein, "alternating positions" refers to a pattern where every other nucleotide is a modified nucleotide or there is an unmodified nucleotide (e.g., an unmodified ribonucleotide) between every modified nucleotide over a defined length of a strand of the dsRNA (e.g., 5'-MNMNMN-3'; 3'-MNMNMN-5'; where M is a modified nucleotide and N is an unmodified nucleotide). The modification pattern starts from the first nucleotide position at either the 5' or 3' terminus according to a position numbering convention, e.g., as described herein (in certain embodiments, position 1 is designated in reference to the terminal residue of a strand following a projected Dicer cleavage event of a DsiRNA agent of the invention; thus, position 1 does not always constitute a 3' terminal or 5' terminal residue of a pre-processed agent of the invention). The pattern of modified nucleotides at alternating positions may run the full length of the strand, but in certain embodiments includes at least 4, 6, 8, 10, 12, 14 nucleotides containing at least 2, 3, 4, 5, 6 or 7 modified nucleotides, respectively. As used herein, "alternating pairs of positions" refers to a pattern where two consecutive modified nucleotides are separated by two consecutive unmodified nucleotides over a defined length of a strand of the dsRNA (e.g., 5'-MMNNMMNNMMNN-3'; 3'-MMNNMMNNMMNN-5'; where M is a modified nucleotide and N is an unmodified nucleotide). The modification pattern starts from the first nucleotide position at either the 5' or 3' terminus according to a position numbering convention such as those described herein. The pattern of modified nucleotides at alternating positions may run the full length of the strand, but preferably includes at least 8, 12, 16, 20, 24, 28 nucleotides containing at least 4, 6, 8, 10, 12 or 14 modified nucleotides, respectively. It is emphasized that the above modification patterns are exemplary and are not intended as limitations on the scope of the invention.

As used herein, "base analog" refers to a heterocyclic moiety which is located at the 1' position of a nucleotide sugar moiety in a modified nucleotide that can be incorporated into a nucleic acid duplex (or the equivalent position in a nucleotide sugar moiety substitution that can be incorporated into a nucleic acid duplex). In the dsRNAs of the invention, a base analog is generally either a purine or pyrimidine base excluding the common bases guanine (G), cytosine (C), adenine (A), thymine (T), and uracil (U). Base analogs can duplex with other bases or base analogs in dsRNAs. Base analogs include those useful in the compounds and methods of the invention, e.g., those disclosed in U.S. Pat. Nos. 5,432,272 and 6,001,983 to Benner and US Patent Publication No. 20080213891 to Manoharan, which are herein incorporated by reference. Non-limiting examples of bases include hypoxanthine (I), xanthine (X), 3β-D-ribofuranosyl-(2,6-diaminopyrimidine) (K), 3-β-D-ribofuranosyl-(1-methyl-pyrazolo[4, 3-d]pyrimidine-5,7(4H,6H)-dione) (P), iso-cytosine (iso-C), iso-guanine (iso-G), 1-β-D-ribofuranosyl-(5-nitroindole), 1-β-D-ribofuranosyl-(3-nitropyrrole), 5-bromouracil, 2-aminopurine, 4-thio-dT, 7-(2-thienyl)-imidazo[4,5-b]pyridine (Ds) and pyrrole-2-carbaldehyde (Pa), 2-amino-6-(2-thienyl)purine (S), 2-oxopyridine (Y), difluorotolyl, 4-fluoro-6-methylbenzimidazole, 4-methylbenzimidazole, 3-methyl isocarbostyrilyl, 5-methyl isocarbostyrilyl, and 3-methyl-7-propynyl isocarbostyrilyl, 7-azaindolyl, 6-methyl-7-azaindolyl, imidizopyridinyl, 9-methyl-imidizopyridinyl, pyrrolopyrizinyl, isocarbostyrilyl, 7-propynyl isocarbostyrilyl, propynyl-7-azaindolyl, 2,4,5-trimethylphenyl, 4-methylindolyl, 4,6-dimethylindolyl, phenyl, napthalenyl, anthracenyl, phenanthracenyl, pyrenyl, stilbenzyl, tetracenyl, pentacenyl, and structural derivates thereof (Schweitzer et al., J. Org. Chem., 59:7238-7242 (1994); Berger et al., Nucleic Acids Research, 28(15):2911-2914 (2000); Moran et al., J. Am. Chem. Soc., 119:2056-2057 (1997); Morales et al., J. Am. Chem. Soc., 121:2323-2324 (1999); Guckian et al., J. Am. Chem. Soc., 118:8182-8183 (1996); Morales et al., J. Am. Chem. Soc., 122(6):1001-1007 (2000); McMinn et al., J. Am. Chem. Soc., 121:11585-11586 (1999); Guckian et al., J. Org. Chem., 63:9652-9656 (1998); Moran et al., Proc. Natl. Acad. Sci., 94:10506-10511 (1997); Das et al., J. Chem. Soc., Perkin Trans., 1:197-206 (2002); Shibata et al., J. Chem. Soc., Perkin Trans., 1: 1605-1611 (2001); Wu et al., J. Am. Chem. Soc., 122(32):7621-7632 (2000); O'Neill et al., J. Org. Chem., 67:5869-5875 (2002); Chaudhuri et al., J. Am. Chem. Soc., 117:10434-10442 (1995); and U.S. Pat. No. 6,218,108.). Base analogs may also be a universal base.

As used herein, "universal base" refers to a heterocyclic moiety located at the 1' position of a nucleotide sugar moiety in a modified nucleotide, or the equivalent position in a nucleotide sugar moiety substitution, that, when present in a nucleic acid duplex, can be positioned opposite more than one type of base without altering the double helical structure (e.g., the structure of the phosphate backbone). Additionally, the universal base does not destroy the ability of the single stranded nucleic acid in which it resides to duplex to a target nucleic acid. The ability of a single stranded nucleic acid containing a universal base to duplex a target nucleic can be assayed by methods apparent to one in the art (e.g., UV absorbance, circular dichroism, gel shift, single stranded nuclease sensitivity, etc.). Additionally, conditions under which duplex formation is observed may be varied to determine duplex stability or formation, e.g., temperature, as melting temperature (Tm) correlates with the stability of nucleic acid duplexes. Compared to a reference single stranded nucleic acid that is exactly complementary to a target nucleic acid, the single stranded nucleic acid containing a universal base forms a duplex with the target nucleic acid that has a lower Tm than a duplex formed with the complementary nucleic acid. However, compared to a reference single stranded nucleic acid in which the universal base has been replaced with a base to generate a single mismatch, the single stranded nucleic acid containing the universal base forms a duplex with the target nucleic acid that has a higher Tm than a duplex formed with the nucleic acid having the mismatched base.

Some universal bases are capable of base pairing by forming hydrogen bonds between the universal base and all of the bases guanine (G), cytosine (C), adenine (A), thymine (T), and uracil (U) under base pair forming conditions. A universal base is not a base that forms a base pair with only one single complementary base. In a duplex, a universal base may form no hydrogen bonds, one hydrogen bond, or more than one hydrogen bond with each of G, C, A, T, and U opposite to it on the opposite strand of a duplex. Preferably, the universal bases does not interact with the base opposite to it on the opposite strand of a duplex. In a duplex, base pairing between a universal base occurs without altering the double helical structure of the phosphate backbone. A universal base may also interact with bases in adjacent nucleotides on the same nucleic acid strand by stacking interactions. Such stacking interactions stabilize the duplex, especially in situations where the universal base does not form any hydrogen bonds with the base positioned opposite to it on the opposite strand of the duplex. Non-limiting examples of universal-binding nucleotides include inosine, 1-β-D-ribofuranosyl-5-nitroindole, and/or 1-β-D-ribofuranosyl-3-nitropyrrole (US Pat. Appl. Publ. No. 20070254362 to Quay et al.; Van Aerschot et al., An acyclic 5-nitroindazole nucleoside analogue as ambiguous nucleoside. Nucleic Acids Res. 1995 Nov. 11; 23(21):4363-70; Loakes et al., 3-Nitropyrrole and 5-nitroindole as universal bases in primers for DNA sequencing and PCR. Nucleic Acids Res. 1995 Jul. 11; 23(13):2361-6; Loakes and Brown, 5-Nitroindole as an universal base analogue. Nucleic Acids Res. 1994 Oct. 11; 22(20):4039-43).

As used herein, "loop" refers to a structure formed by a single strand of a nucleic acid, in which complementary regions that flank a particular single stranded nucleotide region hybridize in a way that the single stranded nucleotide region between the complementary regions is excluded from duplex formation or Watson-Crick base pairing. A loop is a single stranded nucleotide region of any length. Examples of loops include the unpaired nucleotides present in such structures as hairpins, stem loops, or extended loops.

As used herein, "extended loop" in the context of a dsRNA refers to a single stranded loop and in addition 1, 2, 3, 4, 5, 6 or up to 20 base pairs or duplexes flanking the loop. In an extended loop, nucleotides that flank the loop on the 5' side form a duplex with nucleotides that flank the loop on the 3' side. An extended loop may form a hairpin or stem loop.

As used herein, "tetraloop" in the context of a dsRNA refers to a loop (a single stranded region) consisting of four nucleotides that forms a stable secondary structure that contributes to the stability of adjacent Watson-Crick hybridized nucleotides. Without being limited to theory, a tetraloop may stabilize an adjacent Watson-Crick base pair by stacking interactions. In addition, interactions among the four nucleotides in a tetraloop include but are not limited to non-Watson-Crick base pairing, stacking interactions, hydrogen bonding, and contact interactions (Cheong et al., Nature 1990 Aug. 16; 346(6285):680-2; Heus and Pardi, Science 1991 Jul. 12; 253(5016):191-4). A tetraloop confers an increase in the melting temperature (Tm) of an adjacent duplex that is higher than expected from a simple model loop sequence consisting of four random bases. For example, a tetraloop can confer a melting temperature of at least 55° C. in 10 mM $NaHPO_4$ to a hairpin comprising a duplex of at least 2 base pairs in length. A tetraloop may contain ribonucleotides, deoxyribonucleotides, modified nucleotides, and combinations thereof. Examples of RNA tetraloops include the UNCG family of tetraloops (e.g., UUCG), the GNRA family of tetraloops (e.g., GAAA), and the CUUG tetraloop. (Woese et al., Proc Natl Acad Sci USA. 1990 November; 87(21):8467-71; Antao et al., Nucleic Acids Res. 1991 Nov. 11; 19(21):5901-5). Examples of DNA tetraloops include the d(GNNA) family of tetraloops (e.g., d(GTTA), the d(GNRA)) family of tetraloops, the d(GNAB) family of tetraloops, the d(CNNG) family of tetraloops, the d(TNCG) family of tetraloops (e.g., d(TTCG)). (Nakano et al. Biochemistry, 41 (48), 14281-14292, 2002; SHINJI et al. Nippon Kagakkai Koen Yokoshu VOL. 78th; NO. 2; PAGE. 731 (2000).)

As used herein, the term "siRNA" refers to a double stranded nucleic acid in which each strand comprises RNA, RNA analog(s) or RNA and DNA. The siRNA comprises between 19 and 23 nucleotides or comprises 21 nucleotides. The siRNA typically has 2 bp overhangs on the 3' ends of each strand such that the duplex region in the siRNA comprises 17-21 nucleotides, or 19 nucleotides. Typically, the antisense strand of the siRNA is sufficiently complementary with the target sequence of the lactate dehydrogenase gene/RNA.

Where a first sequence is referred to as "substantially complementary" with respect to a second sequence herein, the two sequences can be fully complementary, or they may form one or more, but generally not more than 4, 3 or 2 mismatched base pairs upon hybridization, while retaining the ability to hybridize under the conditions most relevant to their ultimate application. However, where two oligonucleotides are designed to form, upon hybridization, one or more single stranded overhangs, such overhangs shall not be regarded as mismatches with regard to the determination of complementarity. For example, a dsRNA comprising one oligonucleotide 21 nucleotides in length and another oligonucleotide 23 nucleotides in length, wherein the longer oligonucleotide comprises a sequence of 21 nucleotides that is fully complementary to the shorter oligonucleotide, may yet be referred to as "fully complementary" for the purposes of the invention.

The term "double-stranded RNA" or "dsRNA", as used herein, refers to a complex of ribonucleic acid molecules, having a duplex structure comprising two anti-parallel and substantially complementary, as defined above, nucleic acid strands. The two strands forming the duplex structure may be different portions of one larger RNA molecule, or they may be separate RNA molecules. Where separate RNA molecules, such dsRNA are often referred to as siRNA ("short interfering RNA") or DsiRNA ("Dicer substrate siRNAs"). Where the two strands are part of one larger molecule, and therefore are connected by an uninterrupted chain of nucleotides between the 3'-end of one strand and the 5' end of the respective other strand forming the duplex structure, the connecting RNA chain is referred to as a "hairpin loop", "short hairpin RNA" or "shRNA". Where the two strands are connected covalently by means other than an uninterrupted chain of nucleotides between the 3'-end of one strand and the 5' end of the respective other strand forming the duplex structure, the connecting structure is referred to as a "linker". The RNA strands may have the same or a different number of nucleotides. The maximum number of base pairs is the number of nucleotides in the shortest strand of the dsRNA minus any overhangs that are present in the duplex. In addition to the duplex structure, a dsRNA may comprise one or more nucleotide overhangs. In addition, as used herein, "dsRNA" may include chemical modifications to ribonucleotides, internucleoside linkages, end-groups, caps, and conjugated moieties, including substantial modifications at multiple nucleotides and including all types of modifications disclosed herein or known in the art. Any such modifications, as used in a siRNA- or DsiRNA-type molecule, are encompassed by "dsRNA" for the purposes of this specification and claims.

The phrase "duplex region" refers to the region in two complementary or substantially complementary oligonucleotides that form base pairs with one another, either by Watson-Crick base pairing or other manner that allows for a duplex between oligonucleotide strands that are complementary or substantially complementary. For example, an oligonucleotide strand having 21 nucleotide units can base pair with another oligonucleotide of 21 nucleotide units, yet only 19 bases on each strand are complementary or substantially complementary, such that the "duplex region" consists of 19 base pairs. The remaining base pairs may, for example, exist as 5' and 3' overhangs. Further, within the duplex region, 100% complementarity is not required; substantial complementarity is allowable within a duplex region. Substantial complementarity refers to complementarity between the strands such that they are capable of annealing under biological conditions. Techniques to empirically determine if two strands are capable of annealing under biological conditions are well know in the art. Alternatively, two strands can be synthesized and added together under biological conditions to determine if they anneal to one another.

As used herein "DsiRNAmm" refers to a DisRNA having a "mismatch tolerant region" containing one, two, three or four mismatched base pairs of the duplex formed by the sense and antisense strands of the DsiRNA, where such mismatches are positioned within the DsiRNA at a location(s) lying between (and thus not including) the two terminal base pairs of either end of the DsiRNA. The structure and mismatch positioning of exemplary forms of DsiRNAmm compositions are described in greater detail below.

Single-stranded nucleic acids that base pair over a number of bases are said to "hybridize." Hybridization is typically determined under physiological or biologically relevant conditions (e.g., intracellular: pH 7.2, 140 mM potassium ion; extracellular pH 7.4, 145 mM sodium ion). Hybridization conditions generally contain a monovalent cation and biologically acceptable buffer and may or may not contain a divalent cation, complex anions, e.g. gluconate from potassium gluconate, uncharged species such as sucrose, and inert polymers to reduce the activity of water in the sample, e.g. PEG. Such conditions include conditions under which base pairs can form.

Hybridization is measured by the temperature required to dissociate single stranded nucleic acids forming a duplex, i.e., (the melting temperature; Tm). Hybridization conditions are also conditions under which base pairs can form. Various conditions of stringency can be used to determine hybridization (see, e.g., Wahl, G. M. and S. L. Berger (1987) Methods Enzymol. 152:399; Kimmel, A. R. (1987) Methods Enzymol. 152:507). Stringent temperature conditions will ordinarily include temperatures of at least about 30° C., more preferably of at least about 37° C., and most preferably of at least about 42° C. The hybridization temperature for hybrids anticipated to be less than 50 base pairs in length should be 5-10° C. less than the melting temperature (Tm) of the hybrid, where Tm is determined according to the following equations. For hybrids less than 18 base pairs in length, $Tm(° C.)=2(\# \text{ of A+T bases})+4(\# \text{ of G+C bases})$. For hybrids between 18 and 49 base pairs in length, $Tm(° C.)=81.5+16.6(\log_{10}[Na+])+0.41\ (\%\ G+C)-(600/N)$, where N is the number of bases in the hybrid, and [Na+] is the concentration of sodium ions in the hybridization buffer ([Na+] for 1×SSC=0.165 M). For example, a hybridization determination buffer is shown in Table 1.

TABLE 1

| | final conc. | Vender | Cat# | Lot# | m.w./Stock | To make 50 mL solution |
|---|---|---|---|---|---|---|
| NaCl | 100 mM | Sigma | S-5150 | 41K8934 | 5M | 1 mL |
| KCl | 80 mM | Sigma | P-9541 | 70K0002 | 74.55 | 0.298 g |
| $MgCl_2$ | 8 mM | Sigma | M-1028 | 120K8933 | 1M | 0.4 mL |
| sucrose | 2% w/v | Fisher | BP220-212 | 907105 | 342.3 | 1 g |
| Tris-HCl | 16 mM | Fisher | BP1757-500 | 12419 | 1M | 0.8 mL |
| $NaH_2PO_4$ | 1 mM | Sigma | S-3193 | 52H-029515 | 120.0 | 0.006 g |
| EDTA | 0.02 mM | Sigma | E-7889 | 110K89271 | 0.5M | 2 µL |
| $H_2O$ | | Sigma | W-4502 | 51K2359 adjust with HCl | | to 50 mL |
| pH = 7.0 at 20° C. | | | | | | |

Useful variations on hybridization conditions will be readily apparent to those skilled in the art. Hybridization techniques are well known to those skilled in the art and are described, for example, in Benton and Davis (Science 196: 180, 1977); Grunstein and Hogness (Proc. Natl. Acad. Sci., USA 72:3961, 1975); Ausubel et al. (Current Protocols in Molecular Biology, Wiley Interscience, New York, 2001); Berger and Kimmel (Antisense to Molecular Cloning Techniques, 1987, Academic Press, New York); and Sambrook et al., Molecular Cloning: A Laboratory Manual, Cold Spring Harbor Laboratory Press, New York.

As used herein, "oligonucleotide strand" is a single stranded nucleic acid molecule. An oligonucleotide may comprise ribonucleotides, deoxyribonucleotides, modified nucleotides (e.g., nucleotides with 2' modifications, synthetic base analogs, etc.) or combinations thereof. Such modified oligonucleotides can be preferred over native forms because of properties such as, for example, enhanced cellular uptake and increased stability in the presence of nucleases.

As used herein, the term "ribonucleotide" encompasses natural and synthetic, unmodified and modified ribonucleotides. Modifications include changes to the sugar moiety, to the base moiety and/or to the linkages between ribonucleotides in the oligonucleotide. As used herein, the term "ribonucleotide" specifically excludes a deoxyribonucleotide, which is a nucleotide possessing a single proton group at the 2' ribose ring position.

As used herein, the term "deoxyribonucleotide" encompasses natural and synthetic, unmodified and modified deoxyribonucleotides. Modifications include changes to the sugar moiety, to the base moiety and/or to the linkages between deoxyribonucleotide in the oligonucleotide. As used herein, the term "deoxyribonucleotide" also includes a modified ribonucleotide that does not permit Dicer cleavage of a dsRNA agent, e.g., a 2'-O-methyl ribonucleotide, a phosphorothioate-modified ribonucleotide residue, etc., that does not permit Dicer cleavage to occur at a bond of such a residue.

As used herein, the term "PS-NA" refers to a phosphorothioate-modified nucleotide residue. The term "PS-NA" therefore encompasses both phosphorothioate-modified ribonucleotides ("PS-RNAs") and phosphorothioate-modified deoxyribonucleotides ("PS-DNAs").

As used herein, "Dicer" refers to an endoribonuclease in the RNase III family that cleaves a dsRNA or dsRNA-containing molecule, e.g., double-stranded RNA (dsRNA) or pre-microRNA (miRNA), into double-stranded nucleic acid fragments 19-25 nucleotides long, usually with a two-base overhang on the 3' end. With respect to certain dsRNAs of the invention (e.g., "DsiRNAs"), the duplex formed by a dsRNA region of an agent of the invention is recognized by Dicer and is a Dicer substrate on at least one strand of the duplex. Dicer catalyzes the first step in the RNA interference pathway, which consequently results in the degradation of a target RNA. The protein sequence of human Dicer is provided at the NCBI database under accession number NP_085124, hereby incorporated by reference.

Dicer "cleavage" can be determined as follows (e.g., see Collingwood et al., Oligonucleotides 18:187-200 (2008)). In a Dicer cleavage assay, RNA duplexes (100 pmol) are incubated in 20 µL of 20 mM Tris pH 8.0, 200 mM NaCl, 2.5 mM MgCl2 with or without 1 unit of recombinant human Dicer (Stratagene, La Jolla, Calif.) at 37° C. for 18-24 hours. Samples are desalted using a Performa SR 96-well plate (Edge Biosystems, Gaithersburg, Md.). Electrospray-ionization liquid chromatography mass spectroscopy (ESI-LCMS) of duplex RNAs pre- and post-treatment with Dicer is done using an Oligo HTCS system (Novatia, Princeton, N.J.; Hail et al., 2004), which consists of a ThermoFinnigan TSQ7000, Xcalibur data system, ProMass data processing software and Paradigm MS4 HPLC (Michrom BioResources, Auburn, Calif.). In this assay, Dicer cleavage occurs where at least 5%, 10%, 20%, 30%, 40%, 50%, 60%, 70%, 80%, 90%, 95%, or even 100% of the Dicer substrate dsRNA, (i.e., 25-30 bp, dsRNA, preferably 26-30 bp dsRNA) is cleaved to a shorter dsRNA (e.g., 19-23 bp dsRNA, preferably, 21-23 bp dsRNA).

As used herein, "Dicer cleavage site" refers to the sites at which Dicer cleaves a dsRNA (e.g., the dsRNA region of a DsiRNA agent of the invention). Dicer contains two RNase III domains which typically cleave both the sense and antisense strands of a dsRNA. The average distance between the RNase III domains and the PAZ domain determines the length of the short double-stranded nucleic acid fragments it produces and this distance can vary (Macrae et al. (2006) Science 311: 195-8). As shown in FIG. 1, Dicer is projected to cleave certain double-stranded ribonucleic acids of the instant invention that possess an antisense strand having a 2 nucleotide 3' overhang at a site between the $21^{st}$ and $22^{nd}$ nucleotides removed from the 3' terminus of the antisense strand, and at a corresponding site between the $21^{st}$ and $22^{nd}$ nucleotides removed from the 5' terminus of the sense strand. The projected and/or prevalent Dicer cleavage site(s) for dsRNA molecules distinct from those depicted in FIG. 1 may be similarly identified via art-recognized methods, including those described in Macrae et al. While the Dicer cleavage events depicted in FIG. 1 generate 21 nucleotide siRNAs, it is noted that Dicer cleavage of a dsRNA (e.g., DsiRNA) can result in generation of Dicer-processed siRNA lengths of 19 to 23 nucleotides in length. Indeed, in certain embodiments, a double-stranded DNA region may be included within a dsRNA for purpose of directing prevalent Dicer excision of a typically non-preferred 19mer or 20mer siRNA, rather than a 21mer.

In certain embodiments, dsRNAs of the invention are Dicer substrate siRNAs ("DsiRNAs"). DsiRNAs can possess certain advantages as compared to inhibitory nucleic acids that are not dicer substrates ("non-DsiRNAs"). Such advantages include, but are not limited to, enhanced duration of effect of a DsiRNA relative to a non-DsiRNA, as well as enhanced inhibitory activity of a DsiRNA as compared to a non-DsiRNA (e.g., a 19-23mer siRNA) when each inhibitory nucleic acid is suitably formulated and assessed for inhibitory activity in a mammalian cell at the same concentration (in this latter scenario, the DsiRNA would be identified as more potent than the non-DsiRNA). Detection of the enhanced potency of a DsiRNA relative to a non-DsiRNA is often most readily achieved at a formulated concentration (e.g., transfection concentration of the dsRNA) that results in the DsiRNA eliciting approximately 30-70% knockdown activity upon a target RNA (e.g., a mRNA). For active DsiRNAs, such levels of knockdown activity are most often achieved at in vitro mammalian cell DsiRNA transfection concentrations of 1 nM or less of as suitably formulated, and in certain instances are observed at DsiRNA transfection concentrations of 200 pM or less, 100 pM or less, 50 pM or less, 20 pM or less, 10 pM or less, 5 pM or less, or even 1 pM or less. Indeed, due to the variability among DsiRNAs of the precise concentration at which 30-70% knockdown of a target RNA is observed, construction of an $IC_{50}$ curve via assessment of the inhibitory activity of DsiRNAs and non-DsiRNAs across a range of effective concentrations is a preferred method for detecting the enhanced potency of a DsiRNA relative to a non-DsiRNA inhibitory agent.

As used herein, "overhang" refers to unpaired nucleotides, in the context of a duplex having one or more free ends at the 5' terminus or 3' terminus of a dsRNA. In certain embodiments, the overhang is a 3' or 5' overhang on the antisense strand or sense strand. In some embodiments, the overhang is a 3' overhang having a length of between one and six nucleotides, optionally one to five, one to four, one to three, one to two, two to six, two to five, two to four, two to three, three to six, three to five, three to four, four to six, four to five, five to six nucleotides, or one, two, three, four, five or six nucleotides. "Blunt" or "blunt end" means that there are no unpaired nucleotides at that end of the dsRNA, i.e., no nucleotide overhang. For clarity, chemical caps or non-nucleotide chemical moieties conjugated to the 3' end or 5' end of an siRNA are not considered in determining whether an siRNA has an overhang or is blunt ended. In certain embodiments, the invention provides a dsRNA molecule for inhibiting the expression of the lactate dehydrogenase target gene in a cell or mammal, wherein the dsRNA comprises an antisense strand comprising a region of complementarity which is complementary to at least a part of an mRNA formed in the expression of the lactate dehydrogenase target gene, and wherein the region of complementarity is less than 35 nucleotides in length, optionally 19-24 nucleotides in length or 25-30 nucleotides in length, and wherein the dsRNA, upon contact with a cell expressing the lactate dehydrogenase target gene, inhibits the expression of the lactate dehydrogenase target gene by at least 10%, 25%, or 40%.

As used herein, the term "RNA processing" refers to processing activities performed by components of the siRNA, miRNA or RNase H pathways (e.g., Drosha, Dicer, Argonaute2 or other RISC endoribonucleases, and RNaseH), which are described in greater detail below (see "RNA Processing" section below). The term is explicitly distinguished from the post-transcriptional processes of 5' capping of RNA and degradation of RNA via non-RISC- or non-RNase H-mediated processes. Such "degradation" of an RNA can take several forms, e.g. deadenylation (removal of a 3' poly(A) tail), and/or nuclease digestion of part or all of the body of the RNA by one or more of several endo- or exo-nucleases (e.g., RNase III, RNase P, RNase T1, RNase A (1, 2, 3, 4/5), oligonucleotidase, etc.).

By "homologous sequence" is meant a nucleotide sequence that is shared by one or more polynucleotide sequences, such as genes, gene transcripts and/or non-coding polynucleotides. For example, a homologous sequence can be a nucleotide sequence that is shared by two or more genes encoding related but different proteins, such as different members of a gene family, different protein epitopes, different protein isoforms or completely divergent genes, such as a cytokine and its corresponding receptors. A homologous sequence can be a nucleotide sequence that is shared by two or more non-coding polynucleotides, such as noncoding DNA or RNA, regulatory sequences, introns, and sites of transcriptional control or regulation. Homologous sequences can also include conserved sequence regions shared by more than one polynucleotide sequence. Homology does not need to be perfect homology (e.g., 100%), as partially homologous sequences are also contemplated by the instant invention (e.g., 99%, 98%, 97%, 96%, 95%, 94%, 93%, 92%, 91%, 90%, 89%, 88%, 87%, 86%, 85%, 84%, 83%, 82%, 81%, 80% etc.). Indeed, design and use of the dsRNA agents of the instant invention contemplates the possibility of using such dsRNA agents not only against target RNAs of lactate dehydrogenase possessing perfect complementarity with the presently described dsRNA agents, but also against target lactate dehydrogenase RNAs possessing sequences that are, e.g., only 99%, 98%, 97%, 96%, 95%, 94%, 93%, 92%, 91%, 90%, 89%, 88%, 87%, 86%, 85%, 84%, 83%, 82%, 81%, 80% etc. complementary to said dsRNA agents. Similarly, it is contemplated that the presently described dsRNA agents of the instant invention might be readily altered by the skilled artisan to enhance the extent of complementarity between said dsRNA agents and a target lactate dehydrogenase RNA, e.g., of a specific allelic variant of lactate dehydrogenase (e.g., an allele of enhanced therapeutic interest). Indeed, dsRNA agent sequences with insertions, deletions, and single point mutations relative to the target lactate dehydrogenase sequence can also be effective for inhibition. Alternatively, dsRNA agent sequences with nucleotide analog substitutions or insertions can be effective for inhibition.

Sequence identity may be determined by sequence comparison and alignment algorithms known in the art. To determine the percent identity of two nucleic acid sequences (or of two amino acid sequences), the sequences are aligned for comparison purposes (e.g., gaps can be introduced in the first sequence or second sequence for optimal alignment). The nucleotides (or amino acid residues) at corresponding nucleotide (or amino acid) positions are then compared. When a position in the first sequence is occupied by the same residue as the corresponding position in the second sequence, then the molecules are identical at that position. The percent identity between the two sequences is a function of the number of identical positions shared by the sequences (i.e., % homology=# of identical positions/total # of positions×100), optionally penalizing the score for the number of gaps introduced and/or length of gaps introduced.

The comparison of sequences and determination of percent identity between two sequences can be accomplished using a mathematical algorithm. In one embodiment, the alignment generated over a certain portion of the sequence aligned having sufficient identity but not over portions having low degree of identity (i.e., a local alignment). A preferred, non-limiting example of a local alignment algorithm utilized for the comparison of sequences is the algorithm of Karlin and Altschul (1990) *Proc. Natl. Acad. Sci. USA* 87:2264-68, modified as in Karlin and Altschul (1993) *Proc. Natl. Acad. Sci. USA* 90:5873-77. Such an algorithm is incorporated into the BLAST programs (version 2.0) of Altschul, et al. (1990) *J. Mol. Biol.* 215:403-10.

In another embodiment, a gapped alignment, the alignment is optimized by introducing appropriate gaps, and percent identity is determined over the length of the aligned sequences (i.e., a gapped alignment). To obtain gapped alignments for comparison purposes, Gapped BLAST can be utilized as described in Altschul et al., (1997) Nucleic Acids Res. 25(17):3389-3402. In another embodiment, a global alignment the alignment is optimized by introducing appropriate gaps, and percent identity is determined over the entire length of the sequences aligned. (i.e., a global alignment). A preferred, non-limiting example of a mathematical algorithm utilized for the global comparison of sequences is the algorithm of Myers and Miller, CABIOS (1989). Such an algorithm is incorporated into the ALIGN program (version 2.0) which is part of the GCG sequence alignment software package. When utilizing the ALIGN program for comparing amino acid sequences, a PAM120 weight residue table, a gap length penalty of 12, and a gap penalty of 4 can be used.

Greater than 80% sequence identity, e.g., 80%, 81%, 82%, 83%, 84%, 85%, 86%, 87%, 88%, 89%, 90%, 91%, 92%, 93%, 94%, 95%, 96%, 97%, 98%, 99% or even 100% sequence identity, between the dsRNA antisense strand and the portion of the lactate dehydrogenase RNA sequence is preferred. Alternatively, the dsRNA may be defined functionally as a nucleotide sequence (or oligonucleotide sequence) that is capable of hybridizing with a portion of the lactate dehydrogenase RNA (e.g., 400 mM NaCl, 40 mM PIPES pH 6.4, 1 mM EDTA, 50° C. or 70° C. hybridization for 12-16 hours; followed by washing). Additional preferred hybridization conditions include hybridization at 70° C. in 1×SSC or 50° C. in 1×SSC, 50% formamide followed by washing at 70° C. in 0.3×SSC or hybridization at 70° C. in 4×SSC or 50° C. in 4×SSC, 50% formamide followed by washing at 67° C. in 1×SSC. The hybridization temperature for hybrids anticipated to be less than 50 base pairs in length should be 5-10° C. less than the melting temperature (Tm) of the hybrid, where Tm is determined according to the following equations. For hybrids less than 18 base pairs in length, Tm(° C.)=2(# of A+T bases)+4(# of G+C bases). For hybrids between 18 and 49 base pairs in length, Tm(° C.)=81.5+16.6(log 10[Na+])+0.41 (% G+C)−(600/N), where N is the number of bases in the hybrid, and [Na+] is the concentration of sodium ions in the hybridization buffer ([Na+] for 1×SSC=0.165 M). Additional examples of stringency conditions for polynucleotide hybridization are provided in Sambrook, J., E. F. Fritsch, and T. Maniatis, 1989, Molecular Cloning: A Laboratory Manual, Cold Spring Harbor Laboratory Press, Cold Spring Harbor, N.Y., chapters 9 and 11, and Current Protocols in Molecular Biology, 1995, F. M. Ausubel et al., eds., John Wiley & Sons, Inc., sections 2.10 and 6.3-6.4. The length of the identical nucleotide sequences may be at least 10, 12, 15, 17, 20, 22, 25, 27 or 30 bases.

By "conserved sequence region" is meant, a nucleotide sequence of one or more regions in a polynucleotide does not vary significantly between generations or from one biological system, subject, or organism to another biological system, subject, or organism. The polynucleotide can include both coding and non-coding DNA and RNA.

By "sense region" is meant a nucleotide sequence of a dsRNA molecule having complementarity to an antisense region of the dsRNA molecule. In addition, the sense region of a dsRNA molecule can comprise a nucleic acid sequence having homology with a target nucleic acid sequence.

In certain embodiments, an agent of the invention is an "antisense compound" or "antisense oligomeric compound", which refers to an oligomeric compound that is at least partially complementary to the region of a target nucleic acid molecule to which it hybridizes and which modulates (increases or decreases) its expression. This term includes oligonucleotides, oligonucleosides, oligonucleotide analogs, oligonucleotide mimetics, antisense compounds, antisense oligomeric compounds, and chimeric combinations of these, Consequently, while all antisense compounds can be said to be oligomeric compounds, not all oligomeric compounds are antisense compounds. An "antisense oligonucleotide" is an antisense compound that is a nucleic acid-based oligomer. An antisense oligonucleotide can, in some cases, include one or more chemical modifications to the sugar, base, and/or internucleoside linkages. Nonlimiting examples of antisense compounds include primers, probes, antisense compounds, antisense oligonucleotides, external guide sequence (EGS) oligonucleotides, alternate splicers, and siRNAs. As such, these compounds can be introduced in the form of single-stranded, double-stranded, circular, branched or hairpins and can contain structural elements such as internal or terminal bulges or loops. Antisense double-stranded compounds can be two strands hybridized to form double-stranded compounds or a single strand with sufficient self-complementarity to allow for hybridization and formation of a fully or partially double-stranded compound. The compounds of the instant invention are not auto-catalytic. As used herein, "auto-catalytic" means a compound has the ability to promote cleavage of the target RNA in the absence of accessory factors, e.g. proteins.

In one embodiment of the invention, the antisense compound comprises a single stranded oligonucleotide. In some embodiments of the invention the antisense compound contains chemical modifications. In a certain embodiment, the antisense compound is a single stranded, chimeric oligonucleotide wherein the modifications of sugars, bases, and internucleoside linkages are independently selected.

Exemplary antisense compounds in accordance with this invention may comprise an antisense compound from about 12 to about 35 nucleobases or more (i.e. from about 12 to about 35 or more linked nucleosides). In other words, a single-stranded compound of the invention can comprise from about 12 to about 35 nucleobases, and a double-stranded antisense compound of the invention (such as a siRNA, for example, as described elsewhere herein) comprises two strands, each of which is independently from about 12 to about 35 or more nucleobases. This includes oligonucleotides 15 to 35 or more, e.g., 15 to 80 nucleobases in length and 16 to 35 or more nucleobases in length. Contained within the antisense compounds of the invention (whether single or double stranded and on at least one strand) are antisense portions. The "antisense portion" is that part of the antisense compound that is designed to work by one of the aforementioned antisense mechanisms. One of ordinary skill in the art will appreciate that about 12 to about 35 nucleobases includes 12, 13, 14, 15, 16, 17, 18, 19, 20, 21, 22, 23, 24, 25, 26, 27, 28, 29, 30, 31, 32, 33, 34, or 35 nucleobases.

Antisense compounds about 12 to 35 nucleobases in length, optionally about 15 to 35 nucleobases in length, comprising a stretch of at least eight (8), optionally at least 12, e.g., at least 15 consecutive nucleobases targeted to the active target regions, are considered to be suitable antisense compounds as well.

Modifications can be made to the agents, including, e.g., the antisense compounds of the instant invention, and may include conjugate groups attached to one of the termini, selected nucleobase positions, sugar positions or to one or more of the internucleoside linkages. Possible modifications include, but are not limited to, 2'-fluoro (2'-F), 2'-OMethyl (2'-OMe), 2'-Methoxy ethoxy (2'-MOE) sugar modifications, inverted abasic caps, deoxynucleobases, and bicyclic nucleobase analogs such as locked nucleic acids (including LNA) and ENA.

By "antisense region" is meant a nucleotide sequence of a dsRNA molecule having complementarity to a target nucleic acid sequence. In addition, the antisense region of a dsRNA molecule comprises a nucleic acid sequence having complementarity to a sense region of the dsRNA molecule.

As used herein, "antisense strand" refers to a single stranded nucleic acid molecule which has a sequence complementary to that of a target RNA. When the antisense strand contains modified nucleotides with base analogs, it is not necessarily complementary over its entire length, but must at least hybridize with a target RNA.

As used herein, "sense strand" refers to a single stranded nucleic acid molecule which has a sequence complementary to that of an antisense strand. When the antisense strand contains modified nucleotides with base analogs, the sense strand need not be complementary over the entire length of the antisense strand, but must at least duplex with the antisense strand.

As used herein, "guide strand" refers to a single stranded nucleic acid molecule of a dsRNA or dsRNA-containing molecule, which has a sequence sufficiently complementary to that of a target RNA to result in RNA interference. After cleavage of the dsRNA or dsRNA-containing molecule by Dicer, a fragment of the guide strand remains associated with RISC, binds a target RNA as a component of the RISC complex, and promotes cleavage of a target RNA by RISC. As used herein, the guide strand does not necessarily refer to a continuous single stranded nucleic acid and may comprise a discontinuity, preferably at a site that is cleaved by Dicer. A guide strand is an antisense strand.

As used herein, "passenger strand" refers to an oligonucleotide strand of a dsRNA or dsRNA-containing molecule, which has a sequence that is complementary to that of the guide strand. As used herein, the passenger strand does not necessarily refer to a continuous single stranded nucleic acid and may comprise a discontinuity, preferably at a site that is cleaved by Dicer. A passenger strand is a sense strand.

By "target nucleic acid" is meant a nucleic acid sequence whose expression, level or activity is to be modulated. The target nucleic acid can be DNA or RNA. For agents that target lactate dehydrogenase, in certain embodiments, the target nucleic acid is lactate dehydrogenase RNA, e.g., in certain embodiments, lactate dehydrogenase mRNA. lactate dehydrogenase RNA target sites can also interchangeably be referenced by corresponding cDNA sequences. Levels of lactate dehydrogenase may also be targeted via targeting of upstream effectors of lactate dehydrogenase, or the effects of modulated or misregulated lactate dehydrogenase may also be modulated by targeting of molecules downstream of lactate dehydrogenase in the lactate dehydrogenase signalling pathway.

By "complementarity" is meant that a nucleic acid can form hydrogen bond(s) with another nucleic acid sequence by either traditional Watson-Crick or other non-traditional types. In reference to the nucleic molecules of the present invention, the binding free energy for a nucleic acid molecule with its complementary sequence is sufficient to allow the relevant function of the nucleic acid to proceed, e.g., RNAi activity. Determination of binding free energies for nucleic acid molecules is well known in the art (see, e.g., Turner et al., 1987, CSH Symp. Quant. Biol. LII pp. 123-133; Frier et al., 1986, Proc. Nat. Acad. Sci. USA 83:9373-9377; Turner et al., 1987, J. Am. Chem. Soc. 109:3783-3785). A percent complementarity indicates the percentage of contiguous residues in a nucleic acid molecule that can form hydrogen bonds (e.g., Watson-Crick base pairing) with a second nucleic acid sequence (e.g., 5, 6, 7, 8, 9, or 10 nucleotides out of a total of 10 nucleotides in the first oligonucleotide being based paired to a second nucleic acid sequence having 10 nucleotides represents 50%, 60%, 70%, 80%, 90%, and 100% complementary respectively). "Perfectly complementary" means that all the contiguous residues of a nucleic acid sequence will hydrogen bond with the same number of contiguous residues in a second nucleic acid sequence. In one embodiment, a dsRNA molecule of the invention comprises 19 to 30 (e.g., 19, 20, 21, 22, 23, 24, 25, 26, 27, 28, 29, or 30 or more) nucleotides that are complementary to one or more target nucleic acid molecules or a portion thereof.

As used herein, a dsNA, e.g., DsiRNA or siRNA, having a sequence "sufficiently complementary" to a target RNA or cDNA sequence (e.g., lactate dehydrogenase mRNA) means that the dsNA has a sequence sufficient to trigger the destruction of the target RNA (where a cDNA sequence is recited, the RNA sequence corresponding to the recited cDNA sequence) by the RNAi machinery (e.g., the RISC complex) or process. For example, a dsNA that is "sufficiently complementary" to a target RNA or cDNA sequence to trigger the destruction of the target RNA by the RNAi machinery or process can be identified as a dsNA that causes a detectable reduction in the level of the target RNA in an appropriate assay of dsNA activity (e.g., an in vitro assay as described in Example 2 below), or, in further examples, a dsNA that is sufficiently complementary to a target RNA or cDNA sequence to trigger the destruction of the target RNA by the RNAi machinery or process can be identified as a dsNA that produces at least a 5%, at least a 10%, at least a 15%, at least a 20%, at least a 25%, at least a 30%, at least a 35%, at least a 40%, at least a 45%, at least a 50%, at least a 55%, at least a 60%, at least a 65%, at least a 70%, at least a 75%, at least a 80%, at least a 85%, at least a 90%, at least a 95%, at least a 98% or at least a 99% reduction in the level of the target RNA in an appropriate assay of dsNA activity. In additional examples, a dsNA that is sufficiently complementary to a target RNA or cDNA sequence to trigger the destruction of the target RNA by the RNAi machinery or process can be identified based upon assessment of the duration of a certain level of inhibitory activity with respect to the target RNA or protein levels in a cell or organism. For example, a dsNA that is sufficiently complementary to a target RNA or cDNA sequence to trigger the destruction of the target RNA by the RNAi machinery or process can be identified as a dsNA capable of reducing target mRNA levels by at least 20% at least 48 hours post-administration of said dsNA to a cell or organism. Preferably, a dsNA that is sufficiently complementary to a target RNA or cDNA sequence to trigger the destruction of the target RNA by the RNAi machinery or process is identified as a dsNA capable of reducing target mRNA levels by at least 40% at least 72 hours post-administration of said dsNA to a cell or organism, by at least 40% at least four, five or seven days post-administration of said dsNA to a cell or organism, by at least 50% at least 48 hours post-administration of said dsNA to a cell or organism, by at least 50% at least 72 hours post-administration of said dsNA to a cell or organism, by at least 50% at least four, five or seven days post-administration of said dsNA to a cell or organism, by at least 80% at least 48 hours post-administration of said dsNA to a cell or organism, by at least 80% at least 72 hours post-administration of said dsNA to a cell or organism, or by at least 80% at least four, five or seven days post-administration of said dsNA to a cell or organism.

In certain embodiments, a nucleic acid of the invention (e.g., a DsiRNA or siRNA) possesses a sequence "sufficiently complementary to hybridize" to a target RNA or cDNA sequence, thereby achieving an inhibitory effect upon the target RNA. Hybridization, and conditions available for determining whether one nucleic acid is sufficiently complementary to another nucleic acid to allow the two sequences to hybridize, is described in greater detail below.

As will be clear to one of ordinary skill in the art, "sufficiently complementary" (contrasted with, e.g., "100% complementary") allows for one or more mismatches to exist between a dsNA of the invention and the target RNA or cDNA sequence (e.g., lactate dehydrogenase mRNA), provided that the dsNA possesses complementarity sufficient to trigger the destruction of the target RNA by the RNAi machinery (e.g., the RISC complex) or process. In certain embodiments, a "sufficiently complementary" dsNA of the invention can harbor one, two, three or even four or more mismatches between the dsNA sequence and the target RNA or cDNA sequence (e.g., in certain such embodiments, the antisense strand of the dsRNA harbors one, two, three, four, five or even six or more mismatches when aligned with the target RNA or cDNA sequence for maximum complementarity). Additional consideration of the preferred location of such mismatches within certain dsRNAs of the instant invention is considered in greater detail below.

As used herein "cell" is used in its usual biological sense, and does not refer to an entire multicellular organism, e.g., specifically does not refer to a human. The cell can be present in an organism, e.g., birds, plants and mammals such as humans, cows, sheep, apes, monkeys, swine, dogs, and cats. The cell can be prokaryotic (e.g., bacterial cell) or eukaryotic (e.g., mammalian or plant cell). The cell can be of somatic or germ line origin, totipotent or pluripotent, dividing or non-dividing. The cell can also be derived from or can comprise a gamete or embryo, a stem cell, or a fully differentiated cell. Within certain aspects, the term "cell" refers specifically to mammalian cells, such as human cells, that contain one or more dsRNA molecules of the present disclosure. In particular aspects, a cell processes dsRNAs or dsRNA-containing molecules resulting in RNA interference of target nucleic acids, and contains proteins and protein complexes required for RNAi, e.g., Dicer and RISC.

By "RNA" is meant a molecule comprising at least one, and preferably at least 4, 8 and 12 ribonucleotide residues. The at least 4, 8 or 12 RNA residues may be contiguous. By "ribonucleotide" is meant a nucleotide with a hydroxyl group at the 2' position of a β-D-ribofuranose moiety. The terms include double-stranded RNA, single-stranded RNA, RNA such as partially purified RNA, essentially pure RNA, synthetic RNA, recombinantly produced RNA, as well as altered RNA that differs from naturally occurring RNA by the addition, deletion, substitution and/or alteration of one or more nucleotides. Such alterations can include addition of non-nucleotide material, such as to the end(s) of the dsRNA or internally, for example at one or more nucleotides of the RNA. Nucleotides in the RNA molecules of the instant invention can also comprise non-standard nucleotides, such as non-naturally occurring nucleotides or chemically synthesized nucleotides or deoxynucleotides. These altered RNAs can be referred to as analogs or analogs of naturally-occurring RNA.

In certain embodiments, an RNAi agent (e.g., dsRNA) of the invention can be an "isolated" RNAi agent, meaning that the RNAi agent is isolated from (removed and/or purified from) a natural environment.

In some embodiments, an RNAi agent (e.g., dsRNA) of the invention can be a "synthetic" RNAi agent. The term "synthetic" or "non-natural" refers to an RNAi agent (e.g., a dsRNA of the disclosure) that (i) is synthesized using a machine or (ii) that is not derived from a cell or organism that normally produces the RNAi agent.

By "subject" is meant an organism, which is a donor or recipient of explanted cells or the cells themselves. "Subject" also refers to an organism to which the dsRNA agents of the invention can be administered. A subject can be a mammal or mammalian cells, including a human or human cells.

The phrase "pharmaceutically acceptable carrier" refers to a carrier for the administration of a therapeutic agent. Exemplary carriers include saline, buffered saline, dextrose, water, glycerol, ethanol, and combinations thereof. For drugs administered orally, pharmaceutically acceptable carriers include, but are not limited to pharmaceutically acceptable excipients such as inert diluents, disintegrating agents, binding agents, lubricating agents, sweetening agents, flavoring agents, coloring agents and preservatives. Suitable inert diluents include sodium and calcium carbonate, sodium and calcium phosphate, and lactose, while corn starch and alginic acid are suitable disintegrating agents. Binding agents may include starch and gelatin, while the lubricating agent, if present, will generally be magnesium stearate, stearic acid or talc. If desired, the tablets may be coated with a material such as glyceryl monostearate or glyceryl distearate, to delay absorption in the gastrointestinal tract. The pharmaceutically acceptable carrier of the disclosed dsRNA compositions may be micellar structures, such as a liposomes, capsids, capsoids, polymeric nanocapsules, or polymeric microcapsules.

Polymeric nanocapsules or microcapsules facilitate transport and release of the encapsulated or bound dsRNA into the cell. They include polymeric and monomeric materials, especially including polybutylcyanoacrylate. A summary of materials and fabrication methods has been published (see Kreuter, 1991). The polymeric materials which are formed from monomeric and/or oligomeric precursors in the polymerization/nanoparticle generation step, are per se known from the prior art, as are the molecular weights and molecular weight distribution of the polymeric material which a person skilled in the field of manufacturing nanoparticles may suitably select in accordance with the usual skill.

The term "in vitro" has its art recognized meaning, e.g., involving purified reagents or extracts, e.g., cell extracts. The term "in vivo" also has its art recognized meaning, e.g., involving living cells, e.g., immortalized cells, primary cells, cell lines, and/or cells in an organism.

"Treatment", or "treating" as used herein, is defined as the application or administration of a therapeutic agent (e.g., a dsRNA agent or a vector or transgene encoding same) to a patient, or application or administration of a therapeutic agent to an isolated tissue or cell line from a patient, who has a disorder with the purpose to cure, heal, alleviate, relieve, alter, remedy, ameliorate, improve or affect the disease or disorder, or symptoms of the disease or disorder. The term "treatment" or "treating" is also used herein in the context of administering agents prophylactically. The term "effective dose" or "effective dosage" is defined as an amount sufficient to achieve or at least partially achieve the desired effect. The term "therapeutically effective dose" is defined as an amount sufficient to cure or at least partially arrest the disease and its complications in a patient already suffering from the disease. The term "patient" includes human and other mammalian subjects that receive either prophylactic or therapeutic treatment.

As used herein, "neoplasia" means a disease state of a human or an animal in which there are cells and/or tissues which proliferate abnormally. Neoplastic conditions include, but are not limited to, cancers, sarcomas, tumors, leukemias, lymphomas, and the like. A neoplastic condition refers to the disease state associated with the neoplasia. Hepatocellular carcinoma, colon cancer (e.g., colorectal cancer), lung cancer and ovarian cancer are examples (non-limiting) of a neoplastic condition.

A "cancer" in a subject refers to the presence of cells possessing characteristics typical of cancer-causing cells, such as uncontrolled proliferation, immortality, metastatic potential, rapid growth and proliferation rate, and certain characteristic morphological features. Often, cancer cells will be in the form of a tumor, but such cells may exist alone within a subject, or may be a non-tumorigenic cancer cell, such as a leukemia cell. Examples of cancer include but are not limited to hepatic carcinoma, colon cancer, colorectal cancer, breast cancer, a melanoma, adrenal gland cancer, biliary tract cancer, bladder cancer, brain or central nervous system cancer, bronchus cancer, blastoma, carcinoma, a chondrosarcoma, cancer of the oral cavity or pharynx, cervical cancer, esophageal cancer, gastrointestinal cancer, glioblastoma, hepatoma, kidney cancer, leukemia, liver cancer, lung cancer, lymphoma, non-small cell lung cancer, osteosarcoma, ovarian cancer, pancreas cancer, peripheral nervous system cancer, prostate cancer, sarcoma, salivary gland cancer, small bowel or appendix cancer, small-cell lung cancer, squamous cell cancer, stomach cancer, testis cancer, thyroid cancer, urinary bladder cancer, uterine or endometrial cancer, and vulval cancer.

As used herein, the term "tumor" means a mass of transformed cells that are characterized by neoplastic uncontrolled cell multiplication and at least in part, by containing angiogenic vasculature. The abnormal neoplastic cell growth is rapid and continues even after the stimuli that initiated the new growth has ceased. The term "tumor" is used broadly to include the tumor parenchymal cells as well as the supporting stroma, including the angiogenic blood vessels that infiltrate the tumor parenchymal cell mass. Although a tumor generally is a malignant tumor, i.e., a cancer having the ability to metastasize (i.e. a metastatic tumor), a tumor also can be nonmalignant (i.e. non-metastatic tumor). Tumors are hallmarks of cancer, a neoplastic disease the natural course of which is fatal. Cancer cells exhibit the properties of invasion and metastasis and are highly anaplastic.

Various methodologies of the instant invention include at least one step that involves comparing a value, level, feature, characteristic, property, etc. to a "suitable control", referred to interchangeably herein as an "appropriate control". A "suitable control" or "appropriate control" is a control or standard familiar to one of ordinary skill in the art useful for comparison purposes. In one embodiment, a "suitable control" or "appropriate control" is a value, level, feature, characteristic, property, etc. determined prior to performing an RNAi methodology, as described herein. For example, a transcription rate, mRNA level, translation rate, protein level, biological activity, cellular characteristic or property, genotype, phenotype, etc. can be determined prior to introducing an RNA silencing agent (e.g., DsiRNA) of the invention into a cell or organism. In another embodiment, a "suitable control" or "appropriate control" is a value, level, feature, characteristic, property, etc. determined in a cell or organism, e.g., a control or normal cell or organism, exhibiting, for example, normal traits. In yet another embodiment, a "suitable control" or "appropriate control" is a predefined value, level, feature, characteristic, property, etc.

Lactate Dehydrogenase as an RNAi Target

Primary Hyperoxaluria Type 1 (PH1)

Primary hyperoxaluria results in increased excretion of oxalate, with oxalate stones being common. The oxalalate in these common conditions is derived from dietary sources or is secondary to malabsorption. Primary hyperoxaluria, on the other hand, refers to a specific type of hyperoxaluria that is due to a metabolic defect resulting from a heritable genetic defect. PH1 refers to the form of primary hyperoxaluria associated with a metabolic defect of serine-pyruvate aminotransferase (an enzyme that in humans is encoded by the AGXT gene). Types of hyperoxaluria also include: type 2 primary (GRHPR-associated), type 3 primary (DHDPSL-associated), and idiopathic forms of hyperoxaluria.

The buildup of oxalate in the body causes increased excretion of oxalate, which in turn results in renal and bladder stones. Stones cause urinary obstruction (often with severe and acute pain), secondary infection of urine and eventually kidney damage.

Oxalate stones in primary hyperoxaluria tend to be severe, resulting in relatively early kidney damage (e.g., onset in teenage years to early adulthood), which impairs the excretion of oxalate, leading to a further acceleration in accumulation of oxalate in the body.

After the development of renal failure, patients may get deposits of oxalate in the bones, joints and bone marrow. Severe cases may develop haematological problems such as anaemia and thrombocytopaenia. The deposition of oxalate in the body is sometimes called "oxalosis" to be distinguished from "oxaluria" which refers to oxalate in the urine.

Renal failure is a serious complication requiring treatment in its own right. Dialysis can control renal failure but tends to be inadequate to dispose of excess oxalate. Renal transplant is more effective and this is the primary treatment of severe hyperoxaluria. Liver transplantation (often in addition to renal transplant) may be able to control the disease by correcting the metabolic defect.

In a proportion of patients with primary hyperoxaluria type 1, pyridoxine treatment (vitamin B6) may also decrease oxalate excretion and prevent kidney stone formation.

Figure 2:
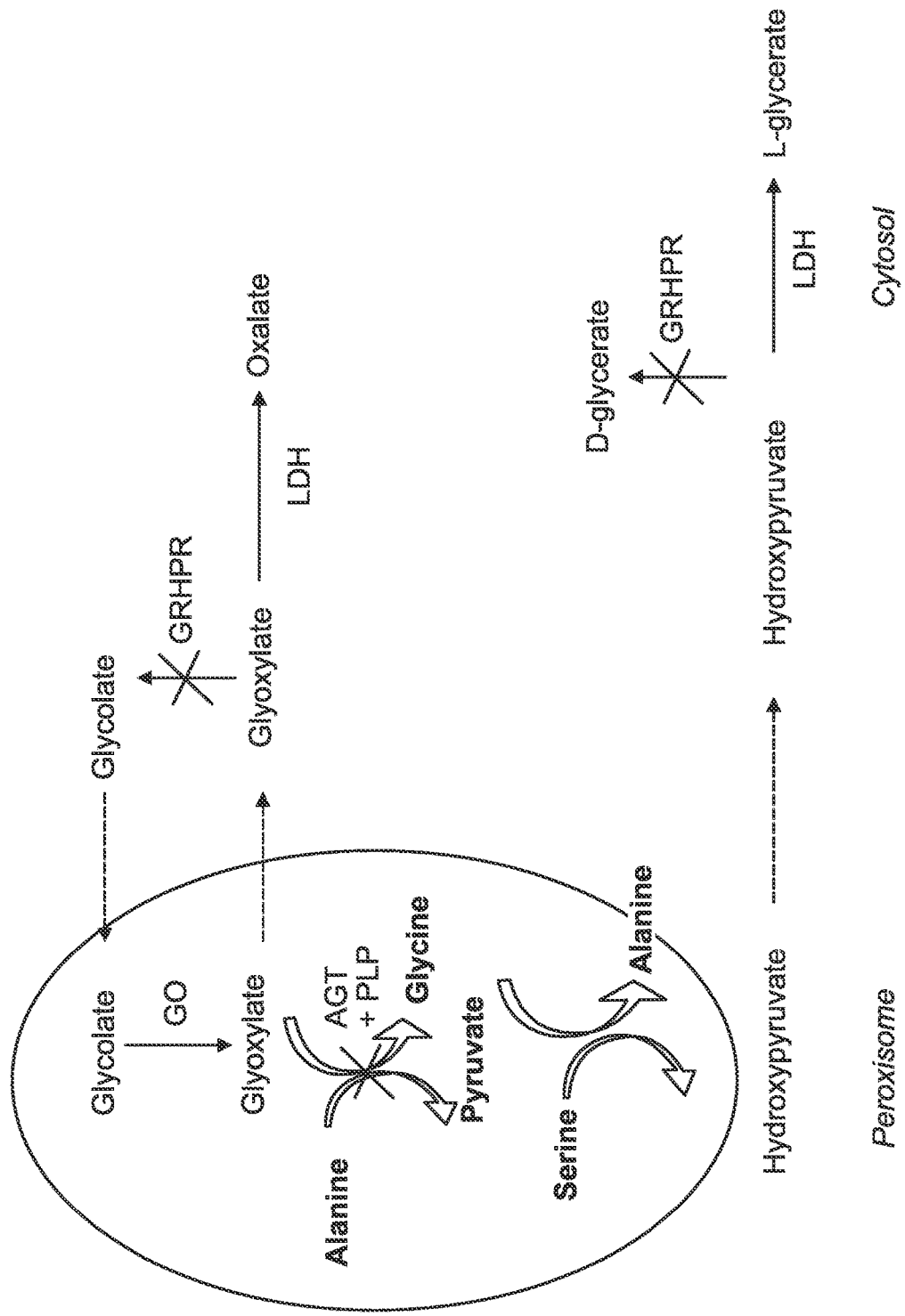
FIG. 2 depicts an image showing glyoxylate metabolism in human liver cells. Dashed and solid lines indicate diffusion across peroxisomal membrane and metabolism, respectively. The metabolic blocks in PH1 (AGT) and PH2 (GRHPR) are designated by the crosses. Oxalate overproduction characterizes both inborn errors of glyoxylate metabolism. However, in PH1, AGT deficiency causes accumulation of glyoxylate and glycolated with increased urinary glycolate execretion, while in PH2, GRHPR deficiency results in L-glycericaciduria. Abbreviations: AGT, alanine: glyoxylate aminotransferase; GRHPR, glyoxylate reductase/hydroxypyruvate reductase; GO, glycolate oxidase; LDH, lactate dehydrogenase; PLP, pyridoxal phosphate.
Figure 3J:
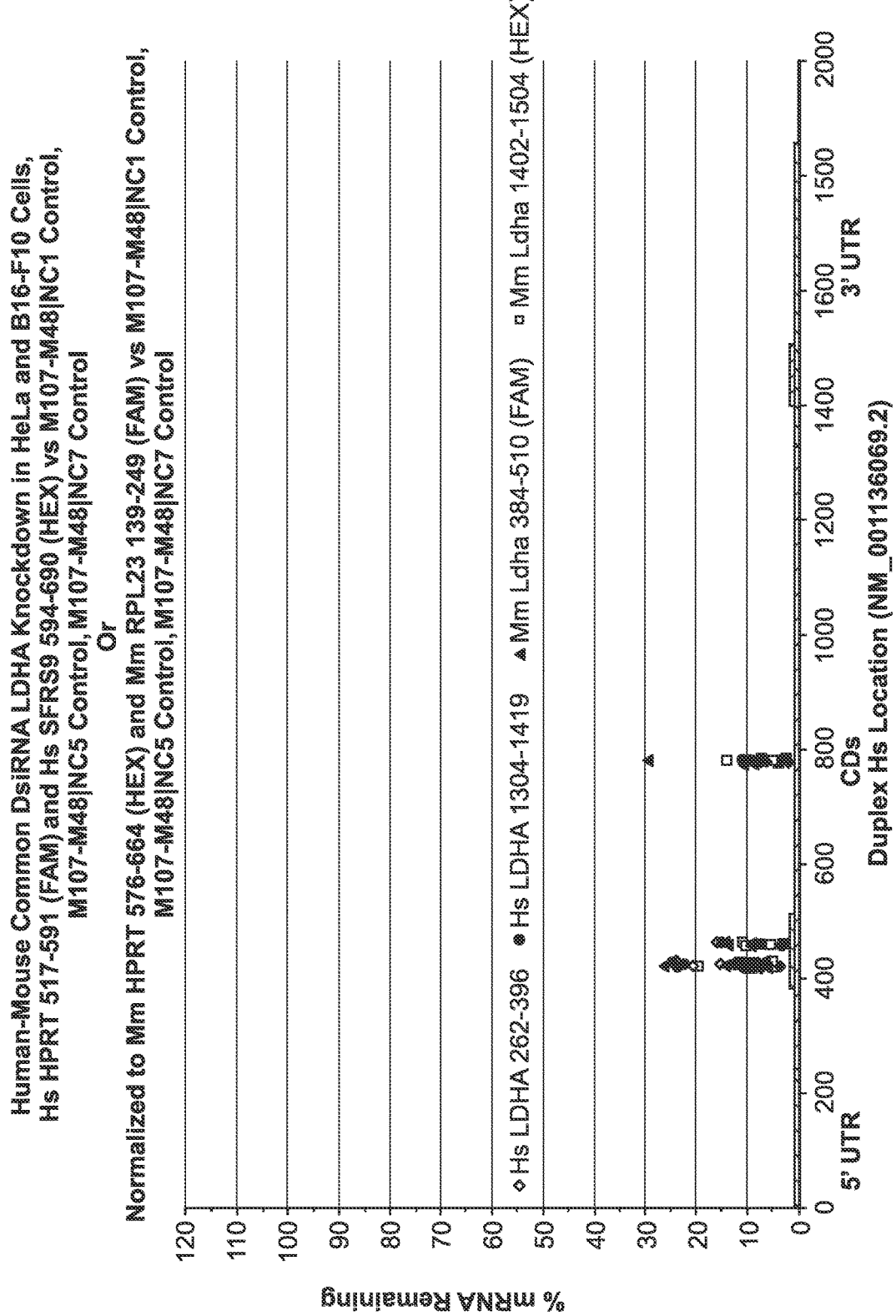

Lactate dehydrogenase is known to act as a dismutase converting glyoxylate to oxalate and glycolate (see FIG. 2). Without wishing to be bound by theory, because an accumulation of oxalate has been identified to cause PH1, inhibition of the enzymes that produce oxalate represents a therapeutic strategy for treatment of PH1. As the final enzyme acting within the oxalate synthesis pathway in the liver, LDH presents an attractive target—especially for liver-targeted dsRNAs, such as LNP-delivered DsiRNAs— for treatment or prevention of PH1.

Primary Types 2 and 3 (PH2 and PH3), and Idiopathic Hyperoxaluria

LHD is an attractive drug therapy target for metabolic disorders that result in oxalate accumulation. While not wishing to be bound by theory, PH1 and PH2 have been described as hereditary disorders of glyoxylate metabolism caused by deficiency of alanine:glyoxylate-aminotransferase (AGT) (Danpure and Jennings, *FEBS Lett* 1986; 201: 20-24) and glyoxylate reductase/hydroxypyruvate reductase (GRHPR) (*Nephrol. Dial. Transplant.* (1995) 10 (supp8): 58-60), respectively. When the activity of these enzymes is absent or reduced, LDH can convert glyoxylate into excess amounts of oxalate, which accumulates without degradation.

PH3, caused by mutations in HOGA1 (formerly DHDPSL), was recently identified (Belostotsky et al *Am J Hum Genet* 2010; 87:392-399). Patients with PH3 often experience calcium oxalate stone disease early in life, with 50% of them presenting with kidney stones before age 5. Data from the Rare Kidney Stone Consortium Primary Hyperoxaluria Registry has suggested that PH3 accounts for approximately 10% of patients with PH of known type. All forms of the PH disease share the common feature of over-production of oxalate from glyoxylate, a reaction catalyzed by LDH. LDH inhibitors such as the dsNAs described herein can thus provide relief to patients of all known forms of PH, as well as to patients having idiopathic forms of hyperoxaluria.

Oncology

LHDA is also an attractive target for cancer therapy because it is required for the initiation, maintenance and progression of tumors (Shi and Pinto, *PLOS ONE* January 2014, Volume 9, Issue 1, e86365; Le et al. *Proc Natl Acad Sci USA* 107: 2037-2042). Up-regulation of LDHA is a characteristic of many cancer types (Goldman R D et al., *Cancer Res* 24: 389-399; Koukourakis M I, et al., *Br J Cancer* 89: 877-885; Koukourakis M I, et al., *LJ Clin Oncol* 24: 4301-4308; Kolev Y, et al., *Ann Surg Oncol* 15: 2336-2344; Zhuang L, et al., *Mod Pathol* 23: 45-53), including, e.g., breast cancer, lymphoma, renal cancer (including renal cell cancer tumors), hereditary leiomyomatosis, pancreatic cancer, liver cancer (including hepatocellular carcinoma), and other forms of cancer.

Cancer cells preferentially undergo glycolysis followed by fermentation, even under aerobic conditions (Warburg O. London: Arnold Constable; 1930; Hanahan and Weinberg Cell 144: 646-674; Ward and Thompson, *CB Cancer Cell* 21: 297-308; Warburg O, *Science* 124: 269-270) and depend on LDHA for the conversion of pyruvate to lactate. It was shown that hereditary leiomyomatosis and renal cancer tumors overexpressed LDHA and that LDHA inhibition resulted in increased apoptosis in these cells (Xie H, et al., *Mol Cancer Ther* 2009; 8(3)). Inhibition of LDHA also impaired cell survival in carcinoma cells (Billiard et al., *Cancer & Metabolism* 2013, 1:19). LHDA inhibitors were also shown to induce lymphoma regression (Le et al. *Proc Natl Acad Sci USA* 107: 2037-2042).

LDHA is an attractive target for cancer therapy also because it is mainly expressed in skeletal muscle and is not present in red blood cells, in which glycolysis is an obligatory process. Individuals with LDHA deficiency only show myoglobinuria under intense exercise (Kanno T, et al., *Clin Chim Acta* 1988; 173:89-98; Kanno T, et al., *Clin Chim Acta* 1980; 108:267-76). Also individuals with complete lack of LDHA or LDHB subunits show no apparent increase in hemolysis (Kanno T, et al., *Curr Top Biol Med Res* 1983; 7:131-50; Miwa S, et al., *Rinsho Byori* 1971; 19 Suppl: 371). It is likely, therefore, that LDHA inhibitors even when delivered systemically will show only modest toxicity, with more targeted forms of delivery expected to mitigate any observed toxicity even further.

Pyruvate Dehydrogenase Deficiency

LHDA is an attractive drug therapy target for metabolic disorders that result in lactic acid accumulation. Pyruvate dehydrogenase (PDH) deficiency (also referred to herein as pyruvate dehydrogenase complex deficiency) is characterized by the buildup of lactic acid in the body and by a variety of neurological problems. The metabolic form presents as severe lactic acidosis with blood lactate concentrations often exceeding 10 mmol/l. Treatment is generally aimed at reversing or minimizing systemic lactic acid accumulation (Brown et al., *J Med Genet.* 31 (11): 875-879). LDHA catalyzes the conversion of pyruvate to lactate; therefore, reducing its activity—optionally in conjunction with other therapy or specialized diet—is likely to provide relief to PDH patients.

Chronic Kidney Disease

In certain aspects of the invention, it was surprisingly identified that targeting of LDHA with the agents of the invention (e.g., RNAi agents) could provide a therapeutic effect for subjects having chronic kidney disease. Without wishing to be bound by theory, it is likely that knockdown of LDHA in a liver-specific manner, which RNAi allows, can provide a therapeutic impact that is relatively free of deleterious effects of loss of LDH activity. In particular, still without wishing to be bound by theory, it is believed that residual LDH activity provided by, e.g., LDHB, allows for LDHA knockdown in the liver not to produce a deleterious effect, which would otherwise be expected if all LDH activity in even the liver was eliminated. Meanwhile, other tissues to which RNAi is currently unable to provide access are believed to benefit from not being subject to RNAi-mediated knockdown of LDHA.

Chronic kidney disease (CKD), also known as chronic renal disease, is a progressive loss in renal function over a period of months or years. The symptoms of worsening kidney function are not specific, and can include feeling generally unwell and experiencing a reduced appetite. Often, chronic kidney disease is diagnosed as a result of screening of people known to be at risk of kidney problems, such as those with high blood pressure or diabetes and those with a blood relative with CKD. This disease may also be identified when it leads to one of its recognized complications, such as cardiovascular disease, anemia, or pericarditis. It is differentiated from acute kidney disease in that the reduction in kidney function must be present for over 3 months.

Chronic kidney disease is identified by a blood test for creatinine, which is a breakdown product of muscle metabolism. Higher levels of creatinine indicate a lower glomerular filtration rate and as a result a decreased capability of the kidneys to excrete waste products. Creatinine levels may be normal in the early stages of CKD, and the condition is discovered if urinalysis (testing of a urine sample) shows the kidney is allowing the loss of protein or red blood cells into the urine. To fully investigate the underlying cause of kidney damage, various forms of medical imaging, blood tests, and sometimes a renal biopsy (removing a small sample of kidney tissue) are employed to find out if a reversible cause for the kidney malfunction is present.

Recent professional guidelines classify the severity of CKD in five stages, with stage 1 being the mildest and usually causing few symptoms and stage 5 being a severe illness with poor life expectancy if untreated. Stage 5 CKD is often called end stage kidney disease, end stage renal disease, or end-stage kidney failure, and is largely synonymous with the now outdated terms chronic renal failure or chronic kidney failure; and usually means the patient requires renal replacement therapy, which may involve a form of dialysis, but ideally constitutes a kidney transplant.

No specific treatment has been unequivocally shown to slow the worsening of CKD. If an underlying cause of CKD, such as vasculitis, or obstructive nephropathy (blockage to the drainage system of the kidneys) is found, it may be treated directly to slow the damage. In more advanced stages, treatments may be required for anemia and renal bone disease (also called renal osteodystrophy, secondary hyperparathyroidism or chronic kidney disease-mineral bone disorder (CKD-MBD)). Chronic kidney disease resulted in 956,000 deaths in 2013, up from 409,000 deaths in 1990.

CKD is initially without specific symptoms and is generally only detected as an increase in serum creatinine or protein in the urine. As the kidney function decreases:

Blood pressure is increased due to fluid overload and production of vasoactive hormones created by the kidney via the renin-angiotensin system, increasing one's risk of developing hypertension and/or suffering from congestive heart failure.

Urea accumulates, leading to azotemia and ultimately uremia (symptoms ranging from lethargy to pericarditis and encephalopathy). Due to its high systemic circulation, urea is excreted in eccrine sweat at high concentrations and crystallizes on skin as the sweat evaporates ("uremic frost").

Potassium accumulates in the blood (hyperkalemia with a range of symptoms including malaise and potentially fatal cardiac arrhythmias). Hyperkalemia usually does not develop until the glomerular filtration rate falls to less than 20-25 ml/min/1.73 m2, at which point the kidneys have decreased ability to excrete potassium. Hyperkalemia in CKD can be exacerbated by acidemia (which leads to extracellular shift of potassium) and from lack of insulin.

Erythropoietin synthesis is decreased causing anemia.

Fluid volume overload symptoms may range from mild edema to life-threatening pulmonary edema.

Hyperphosphatemia, due to reduced phosphate excretion, follows the decrease in glomerular filtration. Hyperphosphatemia is associated with increased cardiovascular risk, being a direct stimulus to vascular calcification.

Hypocalcemia, due to 1.25 dihydroxyvitamin D3 deficiency, is caused by stimulation of fibroblast growth factor-23. Osteocytes are responsible for the increased production of FGF23, which is a potent inhibitor of the enzyme 1-alpha-hydroxylase (responsible for the conversion of 25-hydroxycholecalciferol into 1.25 dihydroxyvitamin D3). Later, this progresses to secondary hyperparathyroidism, renal osteodystrophy, and vascular calcification that further impairs cardiac function.

Metabolic acidosis (due to accumulation of sulfates, phosphates, uric acid etc.) may cause altered enzyme activity by excess acid acting on enzymes; and also increased excitability of cardiac and neuronal membranes by the promotion of hyperkalemia due to excess acid (acidemia). Acidosis is also due to decreased capacity to generate enough ammonia from the cells of the proximal tubule.

Iron deficiency anemia, which increases in prevalence as kidney function decreases, is especially prevalent in those requiring haemodialysis. It is multifactoral in cause, but includes increased inflammation, reduction in erythropoietin, and hyperuricemia leading to bone marrow suppression.

People with CKD suffer from accelerated atherosclerosis and are more likely to develop cardiovascular disease than the general population. Patients afflicted with CKD and cardiovascular disease tend to have significantly worse prognoses than those suffering only from the latter.

Sexual dysfunction is very common in both men and women with CKD. A majority of men have a reduced sex drive, difficulty obtaining an erection, and reaching orgasm, and the problems get worse with age. A majority of women have trouble with sexual arousal, and painful menstruation and problems with performing and enjoying sex are common.

Diagnosis of CKD is largely based on the clinical picture combined with the measurement of the serum creatinine level (see above). In many CKD patients, previous renal disease or other underlying diseases are already known. A significant number present with CKD of unknown cause. In these patients, a cause is occasionally identified retrospectively.

It is important to differentiate CKD from acute kidney injury (AKI) because AKI can be reversible. Abdominal ultrasound, in which the size of the kidneys is measured, is commonly performed. Kidneys with CKD are usually smaller ($\leq 9$ cm) than normal kidneys, with notable exceptions such as in early diabetic nephropathy and polycystic kidney disease. Another diagnostic clue that helps differentiate CKD from AKI is a gradual rise in serum creatinine (over several months or years) as opposed to a sudden increase in the serum creatinine (several days to weeks). If these levels are unavailable (because the patient has been well and has had no blood tests), it is occasionally necessary to treat a patient briefly as having AKI until the renal impairment has been established to be irreversible.

Additional tests may include nuclear medicine MAG3 scan to confirm blood flow and establish the differential function between the two kidneys. Dimercaptosuccinic acid (DMSA) scans are also used in renal imaging; with both MAG3 and DMSA being used chelated with the radioactive element technetium-99.

In CKD numerous uremic toxins accumulate in the blood. Even when ESKD (largely synonymous with CKD5) is treated with dialysis, the toxin levels do not go back to normal as dialysis is not that efficient. Similarly, after a renal transplant, the levels may not go back to normal as the transplanted kidney may not work 100%. If it does, the creatinine level is often normal. The toxins show various cytotoxic activities in the serum and have different molecular weights, and some of them are bound to other proteins, primarily to albumin. Such toxic protein-bound substances are receiving the attention of scientists who are interested in improving the standard chronic dialysis procedures used today.

Screening those who have neither symptoms nor risk factors for CKD is not recommended. Those who should be screened include: those with hypertension or history of cardiovascular disease, those with diabetes or marked obesity, those aged >60 years, subjects with indigenous racial origin, those with a history of renal disease in the past, and subjects who have relatives who had kidney disease requiring dialysis. Screening should include calculation of estimated GFR from the serum creatinine level, and measurement of urine-to-albumin creatinine ratio (ACR) in a first-morning urine specimen (this reflects the amount of a protein called albumin in the urine), as well as a urine dipstick screen for hematuria. The GFR (glomerular filtration rate) is derived from the serum creatinine and is proportional to 1/creatinine, ie it is a reciprocal relationship (the higher the creatinine, the lower the GFR). It reflects one aspect of kidney function: how efficiently the glomeruli (filtering units) work. But as they make up <5% of the mass of the kidney, the GFR does not tell you about all aspects of kidney health and function. This can be done by combining the GFR level with the clinical assessment of the patient (especially fluid state) and measuring the levels of hemoglobin, potassium, phosphate and parathyroid hormone (PTH). Normal GFR is 90-120 mls/min. The units of creatinine vary from country to country.

Guidelines for referral to a nephrologist vary between countries. Though most would agree that nephrology referral is required by Stage 4 CKD (when eGFR/1.73m2 is less than 30 ml/min; or decreasing by more than 3 ml/min/year); and may be useful at an earlier stage (eg CKD3) when urine albumin-to-creatinine ratio is more than 30 mg/mmol, when blood pressure is difficult to control, or when hematuria or other findings suggest either a primarily glomerular disorder or secondary disease amenable to specific treatment. Other benefits of early nephrology referral include proper patient education regarding options for renal replacement therapy as well as pre-emptive transplantation, and timely workup and placement of an arteriovenous fistula in those patients opting for future hemodialysis All individuals with a glomerular filtration rate (GFR)<60 ml/min/1.73 m$^2$ for 3 months are classified as having chronic kidney disease, irrespective of the presence or absence of kidney damage. The rationale for including these individuals is that reduction in kidney function to this level or lower represents loss of half or more of the adult level of normal kidney function, which may be associated with a number of complications such as the development of cardiovascular disease.

The loss of protein in the urine is regarded as an independent marker for worsening of renal function and cardiovascular disease. Hence, British guidelines append the letter "P" to the stage of chronic kidney disease if protein loss is significant.

Stage 1

Slightly diminished function; kidney damage with normal or relatively high GFR (≥90 ml/min/1.73 m$^2$). Kidney damage is defined as pathological abnormalities or markers of damage, including abnormalities in blood or urine tests or imaging studies.

Stage 2

Mild reduction in GFR (60-89 ml/min/1.73 m2) with kidney damage. Kidney damage is defined as pathological abnormalities or markers of damage, including abnormalities in blood or urine tests or imaging studies.

Stage 3

Moderate reduction in GFR (30-59 ml/min/1.73 m2). British guidelines distinguish between stage 3A (GFR 45-59) and stage 3B (GFR 30-44) for purposes of screening and referral.

Stage 4

Severe reduction in GFR (15-29 ml/min/1.73 m2) Preparation for renal replacement therapy.

Stage 5

Established kidney failure (GFR <15 ml/min/1.73 m2), permanent renal replacement therapy, or end-stage kidney disease.

The term nondialysis dependent CKD (NDD-CKD) is a designation used to encompass the status of those persons with an established CKD who do not yet require the life-supporting treatments for renal failure known as renal replacement therapy (RRT, including maintenance dialysis or renal transplantation). The condition of individuals with CKD, who require either of the two types of renal replacement therapy (dialysis or transplant), is referred to as the end-stage renal disease (ESRD). Hence, the start of the ESRD is practically the irreversible conclusion of the NDD-CKD. Even though the NDD-CKD status refers to the status of persons with earlier stages of CKD (stages 1 to 4), patients with advanced stage of CKD (stage 5), who have not yet started renal replacement therapy, are also referred to as NDD-CKD.

The presence of CKD confers a markedly increased risk of cardiovascular disease, and people with CKD often have other risk factors for heart disease, such as high blood lipids. The most common cause of death in people with CKD is cardiovascular disease rather than renal failure. Aggressive treatment of hyperlipidemia is warranted.

Apart from controlling other risk factors, the goal of therapy is to slow down or halt the progression of CKD to stage 5. Control of blood pressure and treatment of the original disease, whenever feasible, are the broad principles of management. Generally, angiotensin converting enzyme inhibitors (ACEIs) or angiotensin II receptor antagonists (ARBs) are used, as they have been found to slow the progression of CKD in forms of the disease with increased levels of protein in the urine. Although the use of ACE inhibitors and ARBs represents the current standard of care for people with CKD, people progressively lose kidney function while on these medications, as seen in the IDNT and RENAL studies, which reported a decrease over time in estimated GFR (an accurate measure of CKD progression, as detailed in the K/DOQI guidelines) in people treated by these conventional methods.

Replacement of erythropoietin and calcitriol, two hormones processed by the kidney, is often necessary in people with advanced disease. Guidelines recommend treatment with parenteral iron prior to treatment with erythropoietin. A target hemoglobin level of 9-12 g/dl is recommended. The normalization of hemoglobin has not been found to be of benefit. It is unclear if androgens help with anemia. Phosphate binders are also used to control the serum phosphate levels, which are usually elevated in advanced chronic kidney disease. Although the evidence for them is limited, phosphodiesterase-5 inhibitors and zinc show potential for helping men with sexual dysfunction.

At stage 5 CKD, renal replacement therapy is usually required, in the form of either dialysis or a transplant.

The prognosis of patients with chronic kidney disease is guarded as epidemiological data have shown that all cause mortality (the overall death rate) increases as kidney function decreases. The leading cause of death in patients with chronic kidney disease is cardiovascular disease, regardless of whether there is progression to stage 5.

While renal replacement therapies can maintain patients indefinitely and prolong life, the quality of life is severely affected. Renal transplantation increases the survival of patients with stage 5 CKD significantly when compared to other therapeutic options; however, it is associated with an increased short-term mortality due to complications of the surgery. Transplantation aside, high-intensity home hemodialysis appears to be associated with improved survival and a greater quality of life, when compared to the conventional three-times-a-week hemodialysis and peritoneal dialysis.

Patients with ESKD are at increased overall risk for cancer. This risk is particularly high in younger patients and gradually diminishes with age. Medical specialty professional organizations recommend that physicians do not perform routine cancer screening in patients with limited life expectancies due to ESKD because evidence does not show that such tests lead to improved patient outcomes.

Chronic kidney disease resulted in 956,000 deaths in 2013 up from 409,000 deaths in 1990.

In Canada, 1.9 to 2.3 million people have CKD.[23] In the US, the Centers for Disease Control and Prevention found that CKD affected an estimated 16.8% of adults aged 20 years and older, during 1999 to 2004. UK estimates suggest that 8.8% of the population of Great Britain and Northern Ireland have symptomatic CKD.

CKD is a major concern in African Americans, mostly due to increased prevalence of hypertension. As an example, 37% of ESKD cases in African Americans can be attributed to high blood pressure, compared with 19% among Caucasians. Treatment efficacy also differs between racial groups. Administration of antihypertensive drugs generally halts disease progression in white populations, but has little effect in slowing renal disease among blacks, and additional treatment such as bicarbonate therapy is often required. While lower socioeconomic status contributes to prevalence of CKD, significant differences in CKD prevalence are still evident between African Americans and Whites when controlling for environmental factors. Studies have shown a true association between history of chronic kidney disease in first- or second-degree relatives, and risk of disease. In addition, African Americans may have higher serum levels of human leukocyte antigens (HLA). High HLA concentrations can contribute to increased systemic inflammation, which indirectly may lead to heightened susceptibility for developing kidney disease. Lack of nocturnal reduction in blood pressure among groups of African Americans is also offered as an explanation, which lends further credence to a genetic etiology of CKD racial disparities.

A high and so-far unexplained incidence of CKD, referred to as the Mesoamerican nephropathy, has been noted among male workers in Central America, mainly in sugar cane fields in the lowlands of El Salvador and Nicaragua. Heat stress from long hours of piece-rate work at high average temperatures (in the range of 96° F.) is suspected, as are agricultural chemicals and other factors. In Sri Lanka, another epidemic of CKD of unknown etiology has become a serious public health concern.

Currently, several compounds are in development for CKD. These include bardoxolone methyl, olmesartan medoxomil, sulodexide, and avosentan. It is contemplated that the agents set forth herein could be used alone or in combination with such therapies, e.g., to treat chronic kidney disease.

While the above-recited diseases and/or disorders are specifically identified herein as targets for LDHA knockdown, it is also contemplated that LDHA knockdown that is either systemic or that is selective for a tissue other than, e.g., liver and/or neoplasia tissue (even including, e.g., muscle tissue), could also exert therapeutic benefit within the correct patient population(s). Accordingly, delivery of the agents of the invention in a manner that is systemic or that preferentially targets tissues other than those most accessible to LNPs (such as liver, pancreatic, kidney, neoplasia and/or blood tissues) is also contemplated. Thus, the LDHA knockdown agents of the invention can optionally be targeted to lung, brain, lymphatic, muscle, etc. tissues.

Exemplary dsNA Structures

Certain aspects of the invention employ dsNA structures to knock down the LDHA target in cells and/or in a subject. Exemplary dsNA structures include the following:

In certain embodiments of the invention, tetraloop- and modified nucleotide-containing dsNAs are contemplated as described, e.g., in US 2011/0288147. In certain such embodiments, a dsNA of the invention possesses a first strand and a second strand, where the first strand and the second strand form a duplex region of 19-25 nucleotides in length, wherein the first strand comprises a 3' region that extends beyond the first strand-second strand duplex region and comprises a series of linking nucleotides, optionally a tetraloop, and the dsNA comprises a discontinuity between the 3' terminus of the first strand and the 5' terminus of the second strand. Optionally, the discontinuity is positioned at a projected dicer cleavage site of the tetraloop-containing dsNA.

In some embodiments, the DsiRNA of the instant invention further comprises a linking moiety or domain that joins the sense and antisense strands of a dsNA of the invention, e.g., a DNA:DNA-extended DsiRNA agent. Optionally, such a linking moiety domain joins the 3' end of the sense strand and the 5' end of the antisense strand. The linking moiety may be a chemical (non-nucleotide) linker, such as an oligomethylenediol linker, oligoethylene glycol linker, or other art-recognized linker moiety. Alternatively, the linker can be a nucleotide linker, optionally including an extended loop and/or tetraloop.

In one embodiment of the present invention, each oligonucleotide of a DsiRNA molecule of the invention is independently 19 to 80 nucleotides in length, in specific embodiments 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79 or 80 or more nucleotides in length. For dsNAs possessing a strand that exceeds 30 nucleotides in length, available structures include those where only one strand exceeds 30 nucleotides in length (see, e.g., U.S. Pat. No. 8,349,809, where an exemplary double stranded nucleic acid possesses a first oligonucleotide strand having a 5' terminus and a 3' terminus and a second oligonucleotide strand having a 5' terminus and a 3' terminus, where each of the 5' termini has a 5' terminal nucleotide and each of the 3' termini has a 3' terminal nucleotide, where the first strand is 15-30 nucleotide residues in length, where starting from the 5' terminal nucleotide (position 1) positions 1 to 15 of the first strand include at least 8 ribonucleotides; the second strand is 36-80 nucleotide residues in length and, starting from the 3' terminal nucleotide, includes at least 8 ribonucleotides in the positions paired with positions 1-15 of the first strand to form a duplex; where at least the 3' terminal nucleotide of the second strand is unpaired with the first strand, and up to 6 consecutive 3' terminal nucleotides are unpaired with the first strand, thereby forming a 3' single stranded overhang of 1-6 nucleotides; where the 5' terminus of the second strand includes from 5-64 consecutive nucleotides which are unpaired with the first strand, thereby forming a 5-64 nucleotide single stranded 5' overhang; where at least the first strand 5' terminal and 3' terminal nucleotides are base paired with nucleotides of the second strand when the first and second strands are aligned for maximum complementarity, thereby forming a substantially duplexed region between the first and second strands; and the second strand is sufficiently complementary to a target RNA along at least 19 ribonucleotides of the second strand length to reduce target gene expression when the double stranded nucleic acid is introduced into a mammalian cell).

In another exemplary embodiment of dsNA structures of the invention, the first strand possesses a 5'-overhang region of 5-61 nucleotides in length, adjacent to the duplex region of sufficient complementarity between first and second strands to allow for duplex formation, where the 3'-terminus of the first strand and the 5'-terminus of the second strand form a blunt structure or form a second strand 5'-overhang of the first strand (e.g., of 1-6 nucleotides in length), where the second strand includes a sequence of at least 19 nucleotides sufficiently complementary to the target LDHA transcript to effect knockdown of LDHA when introduced to mammalian cells.

RNAi therapies are newly identified to provide an attractive, targeted means of treating PH1, PH2, PH3, idiopathic hyperoxaluria, pyruvate dehydrogenase deficiency, chronic kidney disease, cancer and other conditions, diseases or disorders for which reduction of LDH levels, particularly in the liver, can prove therapeutic or otherwise advantageous, at a molecular level. Notably, RNAi therapies, such as the dsRNAs that are specifically exemplified herein, have demonstrated particularly good ability to be delivered to the cells of the liver in vivo (via, e.g., lipid nanoparticles and/or conjugates such as dynamic polyconjugates or GalNAc conjugates—in certain exemplary embodiments, GalNAc can be conjugated to a 3'- and/or 5'-overhang region of a dsNA, optionally to an "extended" overhang region of a dsNA (e.g., to a 5 or more nucleotide, 8 or more nucleotide, etc. example of such an overhang); additionally and/or alternatively, GalNAc can be conjugated to ds extended regions of a dsNA, e.g., to the duplex region formed by the 5'-end region of the guide/antisense strand of a dsNA and the corresponding 3'-end region of the passenger/sense strand of a dsNA and/or to the duplex region formed by the 3'-end region of the guide/antisense strand of a dsNA and the corresponding 5'-end region of the passenger/sense strand of a dsNA). Thus, formulated RNAi therapies, such as those described herein, are attractive modalities for treating or preventing diseases or disorders that are present in, originate in or otherwise involve the liver (e.g., PH1, oxalate accumulation and/or other lactate dehydrogenase-associated diseases or disorders).

Even though a number of embodiments of the invention are directed to liver-targeted delivery of anti-lactate dehydrogenase dsRNAs, use of RNAi therapies to target lactate dehydrogenase at a molecular level in other tissues is also contemplated.

The dsRNA agents of the invention when formulated in delivery vehicles known in the art, e.g., lipid nanoparticles (LNPs) are known to target liver cells more readily than cells of other organs. This effect can be used to therapeutic advantage by avoiding induction of lactate dehydrogenase deficiency in non-liver cells during liver-specific targeting of LDH. Lactate dehydrogenase deficiency is a condition that affects how the body breaks down sugar to use as energy in cells, primarily muscle cells. There are two types of this condition: lactate dehydrogenase-A deficiency (sometimes called glycogen storage disease XI) and lactate dehydrogenase-B deficiency. People with lactate dehydrogenase-A deficiency experience fatigue, muscle pain, and cramps during exercise (exercise intolerance). In some people with lactate dehydrogenase-A deficiency, high-intensity exercise or other strenuous activity leads to the breakdown of muscle tissue (rhabdomyolysis). The destruction of muscle tissue releases a protein called myoglobin, which is processed by the kidneys and released in the urine (myoglobinuria). Myoglobin causes the urine to be red or brown. This protein can also damage the kidneys, in some cases leading to life-threatening kidney failure. Some people with lactate dehydrogenase-A deficiency develop skin rashes. The severity of the signs and symptoms among individuals with lactate dehydrogenase-A deficiency varies greatly. People with lactate dehydrogenase-B deficiency typically do not have any signs or symptoms of the condition. They do not have difficulty with physical activity or any specific physical features related to the condition. Affected individuals are usually discovered only when routine blood tests reveal reduced lactate dehydrogenase activity.

Lactate Dehydrogenase cDNA and Polypeptide Sequences

Known human and mouse lactate dehydrogenase (lactate dehydrogenase A or LDHA) cDNA and polypeptide sequences include the following: human lactate dehydrogenase NM_005566.3 and corresponding human lactate dehydrogenase polypeptide sequence GenBank Accession No. NP_005557.1; and mouse wild-type lactate dehydrogenase sequence GenBank Accession No. NM_001136069.2 (Mus musculus C57BL/6 Ldha, transcript variant 2) and corresponding mouse Ldha polypeptide sequence GenBank Accession No. NP_001129541.2. Other forms of mammalian lactate dehydrogenase include LDHB (NM_002300.6 and NM_008492.2; NP_002291.1 and NP_032518.1) and LDHC (NM_002301.4 and NM_013580.4; NP_002292.1 and NP_030698.1). It is contemplated that certain of the LDHA-targeting nucleic acids of the invention can also be used to target one or more of these additional forms of LDH, in certain instances for therapeutic benefit. Additionally and/or alternatively, combination therapies are contemplated that include both an LDHA-targeting nucleic acid of the invention and one or more inhibitors of LDHB and/or LDHC, in certain instances for added therapeutic benefit.

Assessment of Lactate Dehydrogenase Levels

In certain embodiments, dsRNA-mediated inhibition of a lactate dehydrogenase target sequence is assessed. In such embodiments, lactate dehydrogenase RNA levels can be assessed by art-recognized methods (e.g., RT-PCR, Northern blot, expression array, etc.), optionally via comparison of lactate dehydrogenase levels in the presence of an anti-lactate dehydrogenase dsRNA of the invention relative to the absence of such an anti-lactate dehydrogenase dsRNA. In certain embodiments, lactate dehydrogenase levels in the presence of an anti-lactate dehydrogenase dsRNA are compared to those observed in the presence of vehicle alone, in the presence of a dsRNA directed against an unrelated target RNA, or in the absence of any treatment.

It is also recognized that levels of lactate dehydrogenase protein can be assessed and that lactate dehydrogenase protein levels are, under different conditions, either directly or indirectly related to lactate dehydrogenase RNA levels and/or the extent to which a dsRNA inhibits lactate dehydrogenase expression, thus art-recognized methods of assessing lactate dehydrogenase protein levels (e.g., Western blot, immunoprecipitation, other antibody-based methods, etc.) can also be employed to examine the inhibitory effect of a dsRNA of the invention.

In certain embodiments, potency of a dsRNA of the invention is determined in reference to the number of copies of a dsRNA present in the cytoplasm of a target cell that are required to achieve a certain level of target gene knockdown. For example, in certain embodiments, a potent dsRNA is one capable of causing 50% or greater knockdown of a target mRNA when present in the cytoplasm of a target cell at a copy number of 1000 or fewer RISC-loaded antisense strands per cell. More preferably, a potent dsRNA is one capable of producing 50% or greater knockdown of a target mRNA when present in the cytoplasm of a target cell at a copy number of 500 or fewer RISC-loaded antisense strands per cell. Optionally, a potent dsRNA is one capable of producing 50% or greater knockdown of a target mRNA when present in the cytoplasm of a target cell at a copy number of 300 or fewer RISC-loaded antisense strands per cell.

In further embodiments, the potency of a DsiRNA of the invention can be defined in reference to a 19 to 23mer dsRNA directed to the same target sequence within the same target gene. For example, a DsiRNA of the invention that possesses enhanced potency relative to a corresponding 19 to 23mer dsRNA can be a DsiRNA that reduces a target gene by an additional 5% or more, an additional 10% or more, an additional 20% or more, an additional 30% or more, an additional 40% or more, or an additional 50% or more as compared to a corresponding 19 to 23mer dsRNA, when assayed in an in vitro assay as described herein at a sufficiently low concentration to allow for detection of a potency difference (e.g., transfection concentrations at or below 1 nM in the environment of a cell, at or below 100 pM in the environment of a cell, at or below 10 pM in the environment of a cell, at or below 1 nM in the environment of a cell, in an in vitro assay as described herein; notably, it is recognized that potency differences can be best detected via performance of such assays across a range of concentrations—e.g., 0.1 pM to 10 nM—for purpose of generating a dose-response curve and identifying an $IC_{50}$ value associated with a DsiRNA/dsRNA).

In certain embodiments, a nucleic acid of the invention is administered in an amount sufficient to reduce lactate dehydrogenase target mRNA expression when the nucleic acid is introduced into a mammalian cell. In exemplary embodiments, reduction of lactate dehydrogenase target mRNA expression is assessed to have occurred if lactate dehydrogenase target mRNA levels are decreased by at least 5% or more, 10% or more, 20% or more, 30% or more, 40% or more, 50% or more, 60% or more, 70% or more, 80% or more, or 90% or more, as compared to a corresponding mammalian cell administered an appropriate control that does not include the lactate dehydrogenase-targeting nucleic acid of the invention. In an exemplary embodiment, the mammalian cell used to determine whether reduction of lactate dehydrogenase target mRNA expression has occurred relative to an appropriate control is a HeLa cell, and the lactate dehydrogenase-targeting nucleic acid of the invention is optionally administered via transfection (e.g., using Lipofectamine™) at a concentration of at or below 1 nM in the environment of a cell, at or below 100 pM in the environment of a cell, at or below 10 pM in the environment of a cell, at or below 1 nM in the environment of a cell, in an in vitro assay as described herein.

Lactate dehydrogenase inhibitory levels and/or lactate dehydrogenase levels may also be assessed indirectly, e.g., measurement of a reduced level of PH1 and/or associated phenotypes, and/or other phenotypes associated with oxalate accumulation, can indicate lactate dehydrogenase inhibitory efficacy of a double-stranded nucleic acid of the instant invention.

Models Useful to Evaluate the Down-Regulation of Lactate Dehydrogenase mRNA Levels and Expression Therapeutic agents can be tested in selected animal model(s). For example, a dsRNA agent (or expression vector or transgene encoding same) as described herein can be used in an animal model to determine the efficacy, toxicity, or side effects of treatment with said agent. Alternatively, an agent (e.g., a therapeutic agent) can be used in an animal model to determine the mechanism of action of such an agent.

Cell Culture

The dsRNA agents of the invention can be tested for cleavage activity in vivo, for example, using the following procedure. The nucleotide sequences within the lactate dehydrogenase cDNA targeted by the dsRNA agents of the invention are shown in the above lactate dehydrogenase sequences.

The dsRNA reagents of the invention can be tested in cell culture using HeLa or other mammalian cells (e.g., human cell lines Hep3B, HepG2, DU145, Calu3, SW480, T84, PL45, Huh7 etc., and mouse cell lines B16-F10, AML12, Neuro2a, etc.) to determine the extent of lactate dehydrogenase RNA and lactate dehydrogenase protein inhibition. In certain embodiments, DsiRNA reagents (e.g., see FIG. 1, and exemplary structures recited elsewhere herein) are selected against the lactate dehydrogenase target as described herein. lactate dehydrogenase RNA inhibition is measured after delivery of these reagents by a suitable transfection agent to, for example, cultured HeLa cells or other transformed or non-transformed mammalian cells in culture. Relative amounts of target lactate dehydrogenase RNA are measured versus HPRT1, actin or other appropriate control using real-time PCR monitoring of amplification (e.g., ABI 7700 TAQMAN®). A comparison is made to the activity of oligonucleotide sequences made to unrelated targets or to a randomized DsiRNA control with the same overall length and chemistry, or simply to appropriate vehicle-treated or untreated controls. Primary and secondary lead reagents are chosen for the target and optimization performed.

TAQMAN® (Real-Time PCR Monitoring of Amplification) and Lightcycler Quantification of mRNA Total RNA is prepared from cells following DsiRNA delivery, for example, using Ambion Rnaqueous 4-PCR purification kit for large scale extractions, or Promega SV96 for 96-well assays. For Taqman analysis, dual-labeled probes are synthesized with, for example, the reporter dyes FAM or VIC covalently linked at the 5'-end and the quencher dye TAMRA conjugated to the 3'-end. PCR amplifications are performed on, for example, an ABI PRISM 7700 Sequence detector using 50 uL reactions consisting of 10 uL total RNA, 100 nM forward primer, 100 mM reverse primer, 100 nM probe, 1×TaqMan PCR reaction buffer (PE-Applied Biosystems), 5.5 mM MgCl2, 100 uM each dATP, dCTP, dGTP and dTTP, 0.2 U RNase Inhibitor (Promega), 0.025 U AmpliTaq Gold (PE-Applied Biosystems) and 0.2 U M-MLV Reverse Transcriptase (Promega). The thermal cycling conditions can consist of 30 minutes at 48° C., 10 minutes at 95° C., followed by 40 cycles of 15 seconds at 95° C. and 1 minute at 60° C. Quantitation of target lactate dehydrogenase mRNA level is determined relative to standards generated from serially diluted total cellular RNA (300, 100, 30, 10 ng/rxn) and normalizing to, for example, HPRT1 mRNA in either parallel or same tube TaqMan reactions.

Western Blotting

Cellular protein extracts can be prepared using a standard micro preparation technique (for example using RIPA buffer), or preferably, by extracting nuclear proteins by a method such as the NE-PER Nuclear and Cytoplasmic Extraction kit (Thermo-Fisher Scientific). Cellular protein extracts are run on Tris-Glycine polyacrylamide gel and transferred onto membranes. Non-specific binding can be blocked by incubation, for example, with 5% non-fat milk for 1 hour followed by primary antibody for 16 hours at 4° C. Following washes, the secondary antibody is applied, for example (1:10,000 dilution) for 1 hour at room temperature and the signal detected on a VersaDoc imaging system In several cell culture systems, cationic lipids have been shown to enhance the bioavailability of oligonucleotides to cells in culture (Bennet, et al., 1992, Mol. Pharmacology, 41, 1023-1033). In one embodiment, dsRNA molecules of the invention are complexed with cationic lipids for cell culture experiments. dsRNA and cationic lipid mixtures are prepared in serum-free OptimMEM (InVitrogen) immediately prior to addition to the cells. OptiMEM is warmed to room temperature (about 20-25° C.) and cationic lipid is added to the final desired concentration. dsRNA molecules are added to OptiMEM to the desired concentration and the solution is added to the diluted dsRNA and incubated for 15 minutes at room temperature. In dose response experiments, the RNA complex is serially diluted into OptiMEM prior to addition of the cationic lipid.

Animal Models

The efficacy of anti-lactate dehydrogenase dsRNA agents may be evaluated in an animal model. Animal models of PH1, and/or diseases, conditions, or disorders associated with oxalate accumulation or LDHA overexpression as are known in the art can be used for evaluation of the efficacy, potency, toxicity, etc. of anti-lactate dehydrogenase dsRNAs. Exemplary animal models of PH1 include, e.g., Agxt1 knockout mice. Animal models may be used as a source of cells or tissue for assays of the compositions of the invention. Such models can also be used or adapted for use for pre-clinical evaluation of the efficacy of dsRNA compositions of the invention in modulating lactate dehydrogenase gene expression toward therapeutic use.

Such models and/or wild-type mice can be used in evaluating the efficacy of dsRNA molecules of the invention to inhibit lactate dehydrogenase levels, expression, development of lactate dehydrogenase-associated phenotypes, diseases or disorders, etc. These models, wild-type mice and/or other models can similarly be used to evaluate the safety/toxicity and efficacy of dsRNA molecules of the invention in a pre-clinical setting.

Specific examples of animal model systems useful for evaluation of the lactate dehydrogenase-targeting dsRNAs of the invention include wild-type mice and Agxt1 knockout mice (see, e.g., Hernandez-Fernaud and Salido (*FEBS Journal* 277: 4766-74)). In an exemplary in vivo experiment, dsRNAs of the invention are tail vein injected into such mouse models at doses ranging from 1 to 10 mg/kg or, alternatively, repeated doses are administered at single-dose $IC_{50}$ levels, and organ samples (e.g., liver, but may also include prostate, kidney, lung, pancreas, colon, skin, spleen, bone marrow, lymph nodes, mammary fat pad, etc.) are harvested 24 hours after administration of the final dose. Such organs are then evaluated for mouse and/or human lactate dehydrogenase levels, depending upon the model used. Duration of action can also be examined at, e.g., 1, 4, 7, 14, 21 or more days after final dsRNA administration.

Lactate Dehydrogenase-Targeting dsRNAs

In certain embodiments, an anti-lactate dehydrogenase DsiRNA of the instant invention possesses strand lengths of at least 25 nucleotides. Accordingly, in certain embodiments, an anti-lactate dehydrogenase DsiRNA contains one oligonucleotide sequence, a first sequence, that is at least 25 nucleotides in length and no longer than 35 or up to 50 or more nucleotides. This sequence of RNA can be between 26 and 35, 26 and 34, 26 and 33, 26 and 32, 26 and 31, 26 and 30, and 26 and 29 nucleotides in length. This sequence can be 27 or 28 nucleotides in length or 27 nucleotides in length. The second sequence of the DsiRNA agent can be a sequence that anneals to the first sequence under biological conditions, such as within the cytoplasm of a eukaryotic cell. Generally, the second oligonucleotide sequence will have at least 19 complementary base pairs with the first oligonucleotide sequence, more typically the second oligonucleotide sequence will have 21 or more complementary base pairs, or 25 or more complementary base pairs with the first oligonucleotide sequence. In one embodiment, the second sequence is the same length as the first sequence, and the DsiRNA agent is blunt ended. In another embodiment, the ends of the DsiRNA agent have one or more overhangs.

In certain embodiments, the first and second oligonucleotide sequences of the DsiRNA agent exist on separate oligonucleotide strands that can be and typically are chemically synthesized. In some embodiments, both strands are between 26 and 35 nucleotides in length. In other embodiments, both strands are between 25 and 30 or 26 and 30 nucleotides in length. In one embodiment, both strands are 27 nucleotides in length, are completely complementary and have blunt ends. In certain embodiments of the instant invention, the first and second sequences of an anti-lactate dehydrogenase DsiRNA exist on separate RNA oligonucleotides (strands). In one embodiment, one or both oligonucleotide strands are capable of serving as a substrate for Dicer. In other embodiments, at least one modification is present that promotes Dicer to bind to the double-stranded RNA structure in an orientation that maximizes the double-stranded RNA structure's effectiveness in inhibiting gene expression. In certain embodiments of the instant invention, the anti-lactate dehydrogenase DsiRNA agent is comprised of two oligonucleotide strands of differing lengths, with the anti-lactate dehydrogenase DsiRNA possessing a blunt end at the 3' terminus of a first strand (sense strand) and a 3' overhang at the 3' terminus of a second strand (antisense strand). The DsiRNA can also contain one or more deoxyribonucleic acid (DNA) base substitutions.

Suitable DsiRNA compositions that contain two separate oligonucleotides can be chemically linked outside their annealing region by chemical linking groups. Many suitable chemical linking groups are known in the art and can be used. Suitable groups will not block Dicer activity on the DsiRNA and will not interfere with the directed destruction of the RNA transcribed from the target gene. Alternatively, the two separate oligonucleotides can be linked by a third oligonucleotide such that a hairpin structure is produced upon annealing of the two oligonucleotides making up the DsiRNA composition. The hairpin structure will not block Dicer activity on the DsiRNA and will not interfere with the directed destruction of the target RNA.

The dsRNA molecule can be designed such that every residue of the antisense strand is complementary to a residue in the target molecule. Alternatively, substitutions can be made within the molecule to increase stability and/or enhance processing activity of said molecule. Substitutions can be made within the strand or can be made to residues at the ends of the strand. In certain embodiments, substitutions and/or modifications are made at specific residues within a DsiRNA agent. Such substitutions and/or modifications can include, e.g., deoxy-modifications at one or more residues of positions 1, 2 and 3 when numbering from the 3' terminal position of the sense strand of a DsiRNA agent; and introduction of 2'-O-alkyl (e.g., 2'-O-methyl) modifications at the 3' terminal residue of the antisense strand of DsiRNA agents, with such modifications also being performed at overhang positions of the 3' portion of the antisense strand and at alternating residues of the antisense strand of the DsiRNA that are included within the region of a DsiRNA agent that is processed to form an active siRNA agent. The preceding modifications are offered as exemplary, and are not intended to be limiting in any manner. Further consideration of the structure of preferred DsiRNA agents, including further description of the modifications and substitutions that can be performed upon the anti-lactate dehydrogenase DsiRNA agents of the instant invention, can be found below.

A dsRNA of the invention comprises two RNA strands that are sufficiently complementary to hybridize to form a duplex structure. One strand of the dsRNA (the antisense strand) comprises a region of complementarity that is substantially complementary, and generally fully complementary, to a target sequence, derived from the sequence of an mRNA formed during the expression of the lactate dehydrogenase target gene, the other strand (the sense strand) comprises a region which is complementary to the antisense strand, such that the two strands hybridize and form a duplex structure when combined under suitable conditions. Generally, the duplex structure is between 15 and 35, optionally between 25 and 30, between 26 and 30, between 18 and 25, between 19 and 24, or between 19 and 21 base pairs in length. Similarly, the region of complementarity to the target sequence is between 15 and 35, optionally between 18 and 30, between 25 and 30, between 19 and 24, or between 19 and 21 nucleotides in length. The dsRNA of the invention may further comprise one or more single-stranded nucleotide overhang(s). It has been identified that dsRNAs comprising duplex structures of between 15 and 35 base pairs in length can be effective in inducing RNA interference, including DsiRNAs (generally of at least 25 base pairs in length) and siRNAs (in certain embodiments, duplex structures of siRNAs are between 20 and 23, and optionally, specifically 21 base pairs (Elbashir et al., *EMBO* 20: 6877-6888)). It has also been identified that dsRNAs possessing duplexes shorter than 20 base pairs can be effective as well (e.g., 15, 16, 17, 18 or 19 base pair duplexes). In certain embodiments, the dsRNAs of the invention can comprise at least one strand of a length of 19 nucleotides or more. In certain embodiments, it can be reasonably expected that shorter dsRNAs comprising a sequence complementary to one of the sequences of Tables 4, 6, 9 or 11, minus only a few nucleotides on one or both ends may be similarly effective as compared to the dsRNAs described above and in Tables 2-3, 7-8 and 12. Hence, dsRNAs comprising a partial sequence of at least 15, 16, 17, 18, 19, 20, or more contiguous nucleotides sufficiently complementary to one of the sequences of Tables 4, 6, 9 or 11, and differing in their ability to inhibit the expression of the lactate dehydrogenase target gene in an assay as described herein by not more than 5, 10, 15, 20, 25, or 30% inhibition from a dsRNA comprising the full sequence, are contemplated by the invention. In one embodiment, at least one end of the dsRNA has a single-stranded nucleotide overhang of 1 to 5, optionally 1 to 4, in certain embodiments, 1 or 2 nucleotides. Certain dsRNA structures having at least one nucleotide overhang possess superior inhibitory properties as compared to counterparts possessing base-paired blunt ends at both ends of the dsRNA molecule.

In one embodiment, dsRNA molecules of the invention that down regulate or reduce lactate dehydrogenase gene expression are used for treating, preventing or reducing lactate dehydrogenase-related diseases or disorders (e.g., PH1 or other disease or disorder associated with oxalate accumulation, and/or oncology or pyruvate dehydrogenase deficiency) in a subject or organism.

or those where both strands exceed 30 nucleotides in length (see, e.g., U.S. Pat. No. 8,513,207, where an exemplary double stranded nucleic acid (dsNA) possesses a first oligonucleotide strand having a 5' terminus and a 3' terminus and a second oligonucleotide strand having a 5' terminus and a 3' terminus, where the first strand is 31 to 49 nucleotide residues in length, where starting from the first nucleotide (position 1) at the 5' terminus of the first strand, positions 1 to 23 of the first strand are ribonucleotides; the second strand is 31 to 53 nucleotide residues in length and includes 23 consecutive ribonucleotides that base pair with the ribonucleotides of positions 1 to 23 of the first strand to form a duplex; the 5' terminus of the first strand and the 3' terminus of said second strand form a blunt end or a 1-4 nucleotide 3' overhang; the 3' terminus of the first strand and the 5' terminus of said second strand form a duplexed blunt end, a 5' overhang or a 3' overhang; optionally, at least one of positions 24 to the 3' terminal nucleotide residue of the first strand is a deoxyribonucleotide, optionally, that base pairs with a deoxyribonucleotide of said second strand; and the second strand is sufficiently complementary to a target RNA along at least 19 ribonucleotides of the second strand length to reduce target gene expression when the double stranded nucleic acid is introduced into a mammalian cell).

In certain embodiments, an active dsNA of the invention can possess a 5' overhang of the first strand (optionally, the passenger strand) with respect to the second strand (optionally, the guide strand) of 2-50 nucleotides (e.g., 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50) or more in length. In related embodiments, the duplex region formed by the first and second strands of such a dsNA is 15, 16, 17, 18, 19, 20, 21, 22, 23, 24, 25 or more base pairs in length. The 5' overhang "extended" region of the first strand is optionally modified at one or more residues (optionally, at alternating residues, all residues, or any other selection of residues).

In certain embodiments, an active dsNA of the invention can possess a 3' overhang of the first strand (optionally, the passenger strand) with respect to the second strand (optionally, the guide strand) of 2-50 nucleotides (e.g., 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50) or more in length. In related embodiments, the duplex region formed by the first and second strands of such a dsNA is 15, 16, 17, 18, 19, 20, 21, 22, 23, 24, 25 or more base pairs in length. The 3' overhang "extended" region of the first strand is optionally modified at one or more residues (optionally, at alternating residues, all residues, or any other selection of residues).

In another embodiment of the present invention, each sequence of a DsiRNA molecule of the invention is independently 25 to 35 nucleotides in length, in specific embodiments 25, 26, 27, 28, 29, 30, 31, 32, 33, 34 or 35 nucleotides in length. In another embodiment, the DsiRNA duplexes of the invention independently comprise 25 to 30 base pairs (e.g., 25, 26, 27, 28, 29, or 30). In another embodiment, one or more strands of the DsiRNA molecule of the invention independently comprises 19 to 35 nucleotides (e.g., 19, 20, 21, 22, 23, 24, 25, 26, 27, 28, 29, 30, 31, 32, 33, 34 or 35) that are complementary to a target (lactate dehydrogenase) nucleic acid molecule. In certain embodiments, a DsiRNA molecule of the invention possesses a length of duplexed nucleotides between 25 and 34 nucleotides in length (e.g., 25, 26, 27, 28, 29, 30, 31, 32, 33 or 34 nucleotides in length; optionally, all such nucleotides base pair with cognate nucleotides of the opposite strand). (Exemplary DsiRNA molecules of the invention are shown in FIG. 1, and below.)

Stabilizing modifications (e.g., 2'-O-Methyl, phosphorothioate, deoxyribonucleotides, including dNTP base pairs, 2'-F, etc.) can be incorporated within any double stranded nucleic acid of the invention, and can be used in abundance, particularly within DsiRNAs possessing one or both strands exceeding 30 nucleotides in length.

In certain embodiments, at least 10%, at least 20%, at least 30%, at least 35%, at least 40%, at least 45%, at least 50%, at least 55%, at least 60%, at least 65%, at least 70%, at least 75%, at least 80%, at least 85%, at least 90%, at least 95% or more of the nucleotide residues of a nucleic acid of the instant invention are modified residues. For a dsNA of the invention, at least 10%, at least 20%, at least 30%, at least 35%, at least 40%, at least 45%, at least 50%, at least 55%, at least 60%, at least 65%, at least 70%, at least 75%, at least 80%, at least 85%, at least 90%, at least 95% or more of the nucleotide residues of the first strand are modified residues. Additionally and/or alternatively for a dsNA of the invention, at least 10%, at least 20%, at least 30%, at least 35%, at least 40%, at least 45%, at least 50%, at least 55%, at least 60%, at least 65%, at least 70%, at least 75%, at least 80%, at least 85%, at least 90%, at least 95% or more of the nucleotide residues of the second strand are modified residues. For the dsNAs of the invention, modifications of both duplex (double-stranded) regions and overhang (single-stranded) regions are contemplated. Thus, in certain embodiments, at least 10%, at least 20%, at least 30%, at least 35%, at least 40%, at least 45%, at least 50%, at least 55%, at least 60%, at least 65%, at least 70%, at least 75%, at least 80%, at least 85%, at least 90%, at least 95% or more (e.g., all) duplex nucleotide residues are modified residues. Additionally and/or alternatively, at least 10%, at least 20%, at least 30%, at least 35%, at least 40%, at least 45%, at least 50%, at least 55%, at least 60%, at least 65%, at least 70%, at least 75%, at least 80%, at least 85%, at least 90%, at least 95% or more (e.g., all) overhang nucleotide residues of one or both strands are modified residues. Optionally, the modifications of the dsNAs of the invention do not include an inverted abasic (e.g., inverted deoxy abasic) or inverted dT end-protecting group. Alternatively, a dsNA of the invention includes a terminal cap moiety (e.g., an inverted deoxy abasic and/or inverted dT end-protecting group). Optionally, such a terminal cap moiety is located at the 5' end, at the 3' end, or at both the 5' end and the 3' end of the first strand, of the second strand, or of both first and second strands.

While the guide strand of a double stranded nucleic acid of the invention must possess a sequence of, e.g., 15, 16, 17, 18 or 19 nucleotides that are complementary to a target RNA (e.g., mRNA), additional sequence(s) of the guide strand need not be complementary to the target RNA. The end structures of double stranded nucleic acids possessing at least one strand length in excess of 30 nucleotides can also be varied while continuing to yield functional dsNAs—e.g. the 5' end of the guide strand and the 3' end of the passenger strand may form a 5'-overhang, a blunt end or a 3' overhang (for certain dsNAs, e.g., "single strand extended" dsNAs, the length of such a 5' or 3' overhang can be 1-4, 1-5, 1-6, 1-10, 1-15, 1-20 or even 1-25 or more); similarly, the 3' end of the guide strand and the 5' end of the passenger strand may form a 5'-overhang, a blunt end or a 3' overhang (for certain dsNAs, e.g., "single strand extended" dsNAs, the length of such a 5' or 3' overhang can be 1-4, 1-5, 1-6, 1-10, 1-15, 1-20 or even 1-25 or more). In certain embodiments, the length of the passenger strand is 31-49 nucleotides while the length of the guide strand is 31-53 nucleotides, optionally while the 5' end of the guide strand forms a blunt end (optionally, a base-paired blunt end) with the 3' end of the passenger strand, optionally, with the 3' end of the guide strand and the 5' end of the passenger strand forming a 3' overhang of 1-4 nucleotides in length. Exemplary "extended" Dicer substrate structures are set forth, e.g., in US 2010/0173974 and U.S. Pat. No. 8,349,809, both of which are incorporated herein by reference. In certain embodiments, one or more strands of the dsNA molecule of the invention independently comprises 19 to 35 nucleotides (e.g., 19, 20, 21, 22, 23, 24, 25, 26, 27, 28, 29, 30, 31, 32, 33, 34 or 35) that are complementary to a target (lactate dehydrogenase) nucleic acid molecule. In certain embodiments, a DsiRNA molecule of the invention possesses a length of duplexed nucleotides between 25 and 66 nucleotides, optionally between 25 and 49 nucleotides in length (e.g., 25, 26, 27, 28, 29, 30, 31, 32, 33, 34, 35, 36, 37, 38, 39, 40, 41, 42, 43, 44, 45, 46, 47, 48 or 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80 nucleotides in length; optionally, all such nucleotides base pair with cognate nucleotides of the opposite strand). In related embodiments, a dsNA of the invention possesses strand lengths that are, independently, between 19 and 80 nucleotides in length, optionally between 25 and 53 nucleotides in length, e.g., 19, 20, 21, 22, 23, 24, 25, 26, 27, 28, 29, 30, 31, 32, 33, 34, 35, 36, 37, 38, 39, 40, 41, 42, 43, 44, 45, 46, 47, 48 or 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80 nucleotides in length. In certain embodiments, one strand length is 19-35 nucleotides in length, while the other strand length is 30-80 nucleotides in length and at least one strand has a 5' overhang of at least 5 nucleotides in length relative to the other strand. In certain related embodiments, the 3' end of the first strand and the 5' end of the second strand form a structure that is a blunt end or a 1-6 nucleotide 3' overhang, while the 5' end of the first strand forms a 5-60 nucleotide overhang with respect to the 3' end of the second strand.

Optionally, between one and all nucleotides of the 5-60 nucleotide overhang are modified nucleotides (optionally, deoxyribonucleotides and/or modified ribonucleotides).

In some embodiments, a dsNA of the invention has a first or second strand that has at least 8 contiguous ribonucleotides. In certain embodiments, a dsNA of the invention has 9, 10, 11, 12, 13, 14, 15, 16, 17, 18, 19, 20, 21, 22, 23 or more (e.g., 24, 25, 26, 27, 28, 29, 30, 31, 32, 33, 34, 35, 26, or more, up to the full length of the strand) ribonucleotides, optionally including modified ribonucleotides (2'-O-methyl ribonucleotides, phosphorothioate linkages, etc.). In certain embodiments, the ribonucleotides or modified ribonucleotides are contiguous.

In certain embodiments, a dsNA comprising a first strand and a second strand, each strand, independently, having a 5' terminus and a 3' terminus, and having, independently, respective strand lengths of 25-53 nucleotides in length, is sufficiently highly modified (e.g., at least 10% or more, at least 20% or more, at least 30% or more, at least 40% or more, at least 50% or more, at least 60% or more, at least 70% or more, at least 80% or more, at least 90% or more, at least 95% or more residues of one and/or both strands are modified such that dicer cleavage of the dsNA is prevented (optionally, modified residues occur at and/or flanking one or all predicted dicer cleavage sites of the dsNA). Such non-dicer-cleaved dsNAs retain LDH inhibition activity and are optionally cleaved by non-dicer nucleases to yield, e.g., 15-30, or in particular embodiments, 19-23 nucleotide strand length dsNAs capable of inhibiting LDH in a mammalian cell. In certain related embodiments, dsNAs possessing sufficiently extensive modification to block dicer cleavage of such dsNAs optionally possess regions of unmodified nucleotide residues (e.g., one or two or more consecutive nucleotides, forming a "gap" or "window" in a modification pattern) that allow for and/or promote cleavage of such dsNAs by non-Dicer nucleases. In other embodiments, Dicer-cleaved dsNAs of the invention can include extensive modification patterns that possess such "windows" or "gaps" in modification such that Dicer cleavage preferentially occurs at such sites (as compared to heavily modified regions within such dsNAs).

In certain embodiments, a DsiRNA (in a state as initially formed, prior to dicer cleavage) is more potent at reducing lactate dehydrogenase target gene expression in a mammalian cell than a 19, 20, 21, 22 or 23 base pair sequence that is contained within it. In certain such embodiments, a DsiRNA prior to dicer cleavage is more potent than a 19-21mer contained within it. Optionally, a DsiRNA prior to dicer cleavage is more potent than a 19 base pair duplex contained within it that is synthesized with symmetric dTdT overhangs (thereby forming a siRNA possessing 21 nucleotide strand lengths having dTdT overhangs). In certain embodiments, the DsiRNA is more potent than a 19-23mer siRNA (e.g., a 19 base pair duplex with dTdT overhangs) that targets at least 19 nucleotides of the 21 nucleotide target sequence that is recited for a DsiRNA of the invention (without wishing to be bound by theory, the identity of a such a target site for a DsiRNA is identified via identification of the Ago2 cleavage site for the DsiRNA; once the Ago2 cleavage site of a DsiRNA is determined for a DsiRNA, identification of the Ago2 cleavage site for any other inhibitory dsRNA can be performed and these Ago2 cleavage sites can be aligned, thereby determining the alignment of projected target nucleotide sequences for multiple dsRNAs). In certain related embodiments, the DsiRNA is more potent than a 19-23mer siRNA that targets at least 20 nucleotides of the 21 nucleotide target sequence that is recited for a DsiRNA of the invention. Optionally, the DsiRNA is more potent than a 19-23mer siRNA that targets the same 21 nucleotide target sequence that is recited for a DsiRNA of the invention. In certain embodiments, the DsiRNA is more potent than any 21mer siRNA that targets the same 21 nucleotide target sequence that is recited for a DsiRNA of the invention. Optionally, the DsiRNA is more potent than any 21 or 22mer siRNA that targets the same 21 nucleotide target sequence that is recited for a DsiRNA of the invention. In certain embodiments, the DsiRNA is more potent than any 21, 22 or 23mer siRNA that targets the same 21 nucleotide target sequence that is recited for a DsiRNA of the invention. As noted above, such potency assessments are most effectively performed upon dsRNAs that are suitably formulated (e.g., formulated with an appropriate transfection reagent) at a concentration of 1 nM or less. Optionally, an $IC_{50}$ assessment is performed to evaluate activity across a range of effective inhibitory concentrations, thereby allowing for robust comparison of the relative potencies of dsRNAs so assayed.

The dsRNA molecules of the invention are added directly, or can be complexed with lipids (e.g., cationic lipids), packaged within liposomes, or otherwise delivered to target cells or tissues. The nucleic acid or nucleic acid complexes can be locally administered to relevant tissues ex vivo, or in vivo through direct dermal application, transdermal application, or injection, with or without their incorporation in biopolymers. In particular embodiments, the nucleic acid molecules of the invention comprise sequences shown in FIG. 1, and the below exemplary structures. Examples of such nucleic acid molecules consist essentially of sequences defined in these figures and exemplary structures. Furthermore, where such agents are modified in accordance with the below description of modification patterning of DsiRNA agents, chemically modified forms of constructs described in FIG. 1, and the below exemplary structures can be used in all uses described for the DsiRNA agents of FIG. 1, and the below exemplary structures.

In another aspect, the invention provides mammalian cells containing one or more dsRNA molecules of this invention. The one or more dsRNA molecules can independently be targeted to the same or different sites.

Modified Structures of Anti-Lactate Dehydrogenase DsiRNA Agents

In certain embodiments, the anti-lactate dehydrogenase DsiRNA agents of the invention can have the following structures:

In one such embodiment, the DsiRNA comprises:

5'-XXXXXXXXXXXXXXXXXXXXXXXXX-3'

3'-YXXXXXXXXXXXXXXXXXXXXXXXXX-5' wherein "X"=RNA and "Y" is an overhang domain comprised of 1-4 RNA monomers that are optionally 2'-O-methyl RNA monomers. In a related embodiment, the DsiRNA comprises:

5'-XXXXXXXXXXXXXXXXXXXXXXXDD-3'

3'-YXXXXXXXXXXXXXXXXXXXXXXXXX-5' wherein "X"=RNA, "Y" is an overhang domain comprised of 1-4 RNA monomers that are optionally 2'-O-methyl RNA monomers, and "D"=DNA. In one embodiment, the top strand is the sense strand, and the bottom strand is the antisense strand. Alternatively, the bottom strand is the sense strand and the top strand is the antisense strand.

DsiRNAs of the invention can carry a broad range of modification patterns (e.g., 2'-O-methyl RNA patterns, e.g., within extended DsiRNA agents). Certain modification patterns of the second strand of DsiRNAs of the invention are presented below.

In one embodiment, the DsiRNA comprises:

5'-XXXXXXXXXXXXXXXXXXXXXXXXX-3'

3'-YX<u>XXXXXXXXX</u>XX<u>XXXXXXXXX</u>XXXXX-5' wherein "X"=RNA, "<u>X</u>"=2'-O-methyl RNA, "Y" is an overhang domain comprised of 1-4 RNA monomers that are optionally 2'-O-methyl RNA monomers and underlined residues are 2'-O-methyl RNA monomers. In a related embodiment, the DsiRNA comprises:

5'-XXXXXXXXXXXXXXXXXXXXXXXDD-3'

3'-YX<u>XXXXXXXXX</u>XX<u>XXXXXXXXX</u>XXXXX-5' wherein "X"=RNA, "<u>X</u>"=2'-O-methyl RNA, "Y" is an overhang domain comprised of 1-4 RNA monomers that are optionally 2'-O-methyl RNA monomers and underlined residues are 2'-O-methyl RNA monomers, and "D"=DNA. The top strand is the sense strand, and the bottom strand is the antisense strand.

In another such embodiment, the DsiRNA comprises:

5'-XXXXXXXXXXXXXXXXXXXXXXXXX-3'

3'-YX<u>XXXXXXXXX</u>X<u>XXX</u>XXXXXXXXXX-5' wherein "X"=RNA, "<u>X</u>"=2'-O-methyl RNA, "Y" is an overhang domain comprised of 1-4 RNA monomers that are optionally 2'-O-methyl RNA monomers and underlined residues are 2'-O-methyl RNA monomers. In a related embodiment, the DsiRNA comprises:

5'-XXXXXXXXXXXXXXXXXXXXXXXDD-3'

3'-YX<u>XXXXXXXXX</u>X<u>XXX</u>XXXXXXXXXX-5' wherein "X"=RNA, "<u>X</u>"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand.

In another such embodiment, the DsiRNA comprises:

5'-XXXXXXXXXXXXXXXXXXXXXXXXX-3'

3'-YX<u>XXXXXXXXX</u>XX<u>XXXXX</u>XXXXXXX-5' wherein "X"=RNA, "<u>X</u>"=2'-O-methyl RNA, "Y" is an overhang domain comprised of 1-4 RNA monomers that are optionally 2'-O-methyl RNA monomers and underlined residues are 2'-O-methyl RNA monomers. In a related embodiment, the DsiRNA comprises:

5'-XXXXXXXXXXXXXXXXXXXXXXXDD-3'

3'-YX<u>XXXXXXXXX</u>XX<u>XXXXX</u>XXXXXXX-5' wherein "X"=RNA, "<u>X</u>"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand.

In further embodiments, the DsiRNA comprises:

5'-XXXXXXXXXXXXXXXXXXXXXXXXX-3'

3'-YX<u>XXXXXXXXXX</u>X<u>XXXXXXXXX</u><u>XX</u>-5' wherein "X"=RNA, "<u>X</u>"=2'-O-methyl RNA, "Y" is an overhang domain comprised of 1-4 RNA monomers that are optionally 2'-O-methyl RNA monomers and underlined residues are 2'-O-methyl RNA monomers. In a related embodiment, the DsiRNA comprises:

5'-XXXXXXXXXXXXXXXXXXXXXXXDD-3'

3'-YX<u>XXXXXXXXXX</u>X<u>XXXXXXXXX</u><u>XX</u>-5' wherein "X"=RNA, "<u>X</u>"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In one related embodiment, the DsiRNA comprises:

5'-XXXXXXXXXXXXXXXXXXXXXXXXX-3'

3'-<u>XXXXXXXXXXXXXXX</u>X<u>XXXXXXXXXX</u>-5' wherein "X"=RNA and "<u>X</u>"=2'-O-methyl RNA. In a further related embodiment, the DsiRNA comprises:

5'-XXXXXXXXXXXXXXXXXXXXXXXDD-3'

3'-<u>XXXXXXXXXXXXXXX</u>X<u>XXXXXXXXX</u><u>XX</u>-5' wherein "X"=RNA, "<u>X</u>"=2'-O-methyl RNA, and "D"=DNA. The top strand is the sense strand, and the bottom strand is the antisense strand. This modification pattern is also referred to herein as the "AS-M7" or "M7" modification pattern.

In additional embodiments, the DsiRNA comprises:

5'-XXXXXXXXXXXXXXXXXXXXXXXXX-3'

3'-YX<u>XXXXXXXXXXX</u>X<u>XXXXXXXXX</u><u>XX</u>-5' wherein "X"=RNA, "<u>X</u>"=2'-O-methyl RNA, "Y" is an overhang domain comprised of 1-4 RNA monomers that are optionally 2'-O-methyl RNA monomers and underlined residues are 2'-O-methyl RNA monomers. In a related embodiment, the DsiRNA comprises:

5'-XXXXXXXXXXXXXXXXXXXXXXXDD-3'

3'-YX<u>XXXXXXXXXXX</u>X<u>XXXXXXXXX</u><u>XX</u>-5' wherein "X"=RNA, "<u>X</u>"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. The top strand is the sense strand, and the bottom strand is the antisense strand. In another related embodiment, the DsiRNA comprises:

wherein "X"=RNA and "X"=2'-O-methyl RNA. The top strand is the sense strand, and the bottom strand is the antisense strand. In a further related embodiment, the DsiRNA comprises:

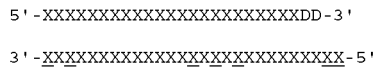

wherein "X"=RNA, "X"=2'-O-methyl RNA, and "D"=DNA. The top strand is the sense strand, and the bottom strand is the antisense strand. This modification pattern is also referred to herein as the "AS-M6" or "M6" modification pattern.

In other embodiments, the DsiRNA comprises:

wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In a related embodiment, the DsiRNA comprises:

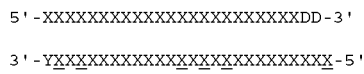

wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In one related embodiment, the DsiRNA comprises:

wherein "X"=RNA and "X"=2'-O-methyl RNA. The top strand is the sense strand, and the bottom strand is the antisense strand. In another related embodiment, the DsiRNA comprises:

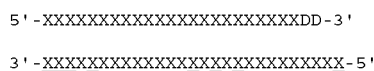

wherein "X"=RNA, "X"=2'-O-methyl RNA, and "D"=DNA. The top strand is the sense strand, and the bottom strand is the antisense strand. This modification pattern is also referred to herein as the "AS-M5" or "M5" modification pattern.

In further embodiments, the DsiRNA comprises:

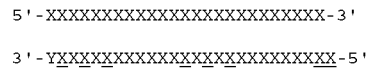

wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In a related embodiment, the DsiRNA comprises:

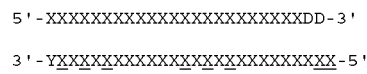

wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In one related embodiment, the DsiRNA comprises:

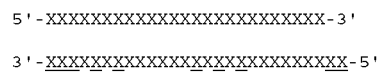

wherein "X"=RNA and "X"=2'-O-methyl RNA. The top strand is the sense strand, and the bottom strand is the antisense strand. In a further related embodiment, the DsiRNA comprises:

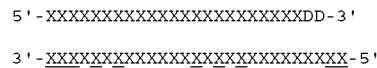

wherein "X"=RNA, "X"=2'-O-methyl RNA, and "D"=DNA. The top strand is the sense strand, and the bottom strand is the antisense strand. This modification pattern is also referred to herein as the "AS-M4" or "M4" modification pattern.

In additional embodiments, the DsiRNA comprises:

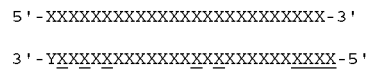

wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In a related embodiment, the DsiRNA comprises:

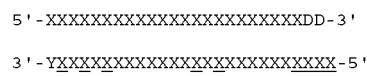

wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

```
5'-XXXXXXXXXXXXXXXXXXXXXXXXX-3'

3'-XXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'

3'-XXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M8" or "M8" modification pattern.

In other embodiments, the DsiRNA comprises:

```
5'-XXXXXXXXXXXXXXXXXXXXXXXXX-3'

3'-YXXXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

```
5'-XXXXXXXXXXXXXXXXXXXXXXXDD-3'

3'-YXXXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

```
5'-XXXXXXXXXXXXXXXXXXXXXXXXX-3'

3'-XXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'

3'-XXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M3" or "M3" modification pattern.

In additional embodiments, the DsiRNA comprises:

```
5'-XXXXXXXXXXXXXXXXXXXXXXXXX-3'

3'-YXXXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In a related embodiment, the DsiRNA comprises:

```
5'-XXXXXXXXXXXXXXXXXXXXXXXDD-3'

3'-YXXXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

```
5'-XXXXXXXXXXXXXXXXXXXXXXXXX-3'

3'-XXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'

3'-XXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M2" or "M2" modification pattern.

In further embodiments, the DsiRNA comprises:

```
5'-XXXXXXXXXXXXXXXXXXXXXXXXX-3'

3'-YXXXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In a related embodiment, the DsiRNA comprises:

```
5'-XXXXXXXXXXXXXXXXXXXXXXXDD-3'

3'-YXXXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

```
5'-XXXXXXXXXXXXXXXXXXXXXXXXX-3'
```

```
3'-XXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'
3'-XXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M1" or "M1" modification pattern.

In additional embodiments, the DsiRNA comprises:

```
5'-XXXXXXXXXXXXXXXXXXXXXXXXX-3'
3'-YXXXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

```
5'-XXXXXXXXXXXXXXXXXXXXXXXDD-3'
3'-YXXXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'
3'-XXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M9" or "M9" modification pattern.

In other embodiments, the DsiRNA comprises:

```
5'-XXXXXXXXXXXXXXXXXXXXXXXXX-3'
3'-YXXXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In a related embodiment, the DsiRNA comprises:

```
5'-XXXXXXXXXXXXXXXXXXXXXXXDD-3'
3'-YXXXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'
3'-XXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M10" or "M10" modification pattern.

In further embodiments, the DsiRNA comprises:

```
5'-XXXXXXXXXXXXXXXXXXXXXXXXX-3'
3'-YXXXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

```
5'-XXXXXXXXXXXXXXXXXXXXXXXDD-3'
3'-YXXXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

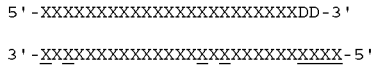

wherein "X"=RNA, "X"=2'-O-methyl RNA, and "D"=DNA. The top strand is the sense strand, and the bottom strand is the antisense strand. This modification pattern is also referred to herein as the "AS-M11" or "M11" modification pattern.

In additional embodiments, the DsiRNA comprises:

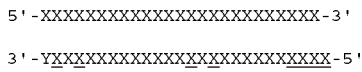

wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

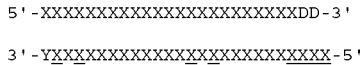

wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

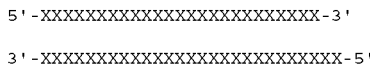

wherein "X"=RNA and "X"=2'-O-methyl RNA. The top strand is the sense strand, and the bottom strand is the antisense strand. In a further related embodiment, the DsiRNA comprises:

wherein "X"=RNA, "X"=2'-O-methyl RNA, and "D"=DNA. The top strand is the sense strand, and the bottom strand is the antisense strand. This modification pattern is also referred to herein as the "AS-M12" or "M12" modification pattern.

In further embodiments, the DsiRNA comprises:

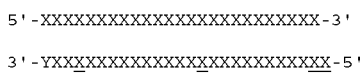

wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

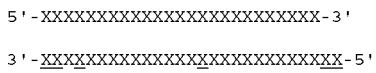

wherein "X"=RNA and "X"=2'-O-methyl RNA. The top strand is the sense strand, and the bottom strand is the antisense strand. In a further related embodiment, the DsiRNA comprises:

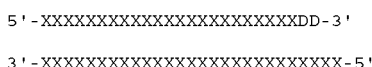

wherein "X"=RNA, "X"=2'-O-methyl RNA, and "D"=DNA. The top strand is the sense strand, and the bottom strand is the antisense strand. This modification pattern is also referred to herein as the "AS-M13" or "M13" modification pattern.

In other embodiments, the DsiRNA comprises:

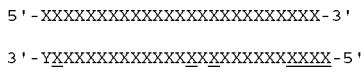

wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In another related embodiment, the DsiRNA comprises:

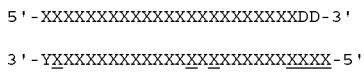

wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

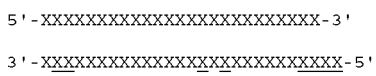

wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'
3'-XXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M21" or "M21" modification pattern.

In further embodiments, the DsiRNA comprises:

```
5'-XXXXXXXXXXXXXXXXXXXXXXXXX-3'
3'-YXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

```
5'-XXXXXXXXXXXXXXXXXXXXXXXDD-3'
3'-YXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

```
5'-XXXXXXXXXXXXXXXXXXXXXXXXX-3'
3'-XXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'
3'-XXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M14" or "M14" modification pattern.

In additional embodiments, the DsiRNA comprises:

```
5'-XXXXXXXXXXXXXXXXXXXXXXXXX-3'
3'-YXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

```
5'-XXXXXXXXXXXXXXXXXXXXXXXDD-3'
3'-YXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

```
5'-XXXXXXXXXXXXXXXXXXXXXXXXX-3'
3'-XXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'
3'-XXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M15" or "M15" modification pattern.

In further embodiments, the DsiRNA comprises:

```
5'-XXXXXXXXXXXXXXXXXXXXXXXXX-3'
3'-YXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In a related embodiment, the DsiRNA comprises:

```
5'-XXXXXXXXXXXXXXXXXXXXXXXDD-3'
3'-YXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

```
5'-XXXXXXXXXXXXXXXXXXXXXXXXX-3'
3'-XXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'
```

3'-XXXXXXXXXXXXXXXXXXXXXXXXXXX-5' wherein "X"=RNA, "X"=2'-O-methyl RNA, and "D"=DNA. The top strand is the sense strand, and the bottom strand is the antisense strand. This modification pattern is also referred to herein as the "AS-M16" or "M16" modification pattern.

In additional embodiments, the DsiRNA comprises:

5'-XXXXXXXXXXXXXXXXXXXXXXXX-3'

3'-YXXXXXXXXXXXXXXXXXXXXXXXXXX-5' wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

5'-XXXXXXXXXXXXXXXXXXXXXXXXDD-3'

3'-YXXXXXXXXXXXXXXXXXXXXXXXXXX-5' wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

5'-XXXXXXXXXXXXXXXXXXXXXXXX-3'

3'-XXXXXXXXXXXXXXXXXXXXXXXXXX-5' wherein "X"=RNA and "X"=2'-O-methyl RNA. The top strand is the sense strand, and the bottom strand is the antisense strand. In a further related embodiment, the DsiRNA comprises:

5'-XXXXXXXXXXXXXXXXXXXXXXXXDD-3'

3'-XXXXXXXXXXXXXXXXXXXXXXXXXX-5' wherein "X"=RNA, "X"=2'-O-methyl RNA, and "D"=DNA. The top strand is the sense strand, and the bottom strand is the antisense strand. This modification pattern is also referred to herein as the "AS-M17" or "M17" modification pattern.

In further embodiments, the DsiRNA comprises:

5'-XXXXXXXXXXXXXXXXXXXXXXXX-3'

3'-YXXXXXXXXXXXXXXXXXXXXXXXXX-5' wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

5'-XXXXXXXXXXXXXXXXXXXXXXXXDD-3'

3'-YXXXXXXXXXXXXXXXXXXXXXXXXXX-5' wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

5'-XXXXXXXXXXXXXXXXXXXXXXXX-3'

3'-XXXXXXXXXXXXXXXXXXXXXXXXXX-5' wherein "X"=RNA and "X"=2'-O-methyl RNA. The top strand is the sense strand, and the bottom strand is the antisense strand. In a further related embodiment, the DsiRNA comprises:

5'-XXXXXXXXXXXXXXXXXXXXXXXXDD-3'

3'-XXXXXXXXXXXXXXXXXXXXXXXXXX-5' wherein "X"=RNA, "X"=2'-O-methyl RNA, and "D"=DNA. The top strand is the sense strand, and the bottom strand is the antisense strand. This modification pattern is also referred to herein as the "AS-M18" or "M18" modification pattern.

In additional embodiments, the DsiRNA comprises:

5'-XXXXXXXXXXXXXXXXXXXXXXXX-3'

3'-YXXXXXXXXXXXXXXXXXXXXXXXXXX-5' wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

5'-XXXXXXXXXXXXXXXXXXXXXXXXDD-3'

3'-YXXXXXXXXXXXXXXXXXXXXXXXXXX-5' wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

5'-XXXXXXXXXXXXXXXXXXXXXXXX-3'

3'-XXXXXXXXXXXXXXXXXXXXXXXXXX-5' wherein "X"=RNA and "X"=2'-O-methyl RNA. The top strand is the sense strand, and the bottom strand is the antisense strand. In a further related embodiment, the DsiRNA comprises:

5'-XXXXXXXXXXXXXXXXXXXXXXXXDD-3'

3'-XXXXXXXXXXXXXXXXXXXXXXXXXX-5' wherein "X"=RNA, "X"=2'-O-methyl RNA, and "D"=DNA. The top strand is the sense strand, and the bottom strand is the antisense strand. This modification pattern is also referred to herein as the "AS-M19" or "M19" modification pattern.

In further embodiments, the DsiRNA comprises:

5'-XXXXXXXXXXXXXXXXXXXXXXX-3'

3'-YXXXXXXXXXXXXXXXXXXXXXXXX-5' wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

5'-XXXXXXXXXXXXXXXXXXXXXXXDD-3'

3'-YXXXXXXXXXXXXXXXXXXXXXXXX-5' wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

5'-XXXXXXXXXXXXXXXXXXXXXXX-3'

3'-XXXXXXXXXXXXXXXXXXXXXXXXX-5' wherein "X"=RNA and "X"=2'-O-methyl RNA. The top strand is the sense strand, and the bottom strand is the antisense strand. In a further related embodiment, the DsiRNA comprises:

5'-XXXXXXXXXXXXXXXXXXXXXXXDD-3'

3'-XXXXXXXXXXXXXXXXXXXXXXXXX-5' wherein "X"=RNA, "X"=2'-O-methyl RNA, and "D"=DNA. The top strand is the sense strand, and the bottom strand is the antisense strand. This modification pattern is also referred to herein as the "AS-M20" or "M20" modification pattern.

In additional embodiments, the DsiRNA comprises:

5'-XXXXXXXXXXXXXXXXXXXXXXX-3'

3'-YXXXXXXXXXXXXXXXXXXXXXXXX-5' wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

5'-XXXXXXXXXXXXXXXXXXXXXXXDD-3'

3'-YXXXXXXXXXXXXXXXXXXXXXXXX-5' wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

5'-XXXXXXXXXXXXXXXXXXXXXXX-3'

3'-XXXXXXXXXXXXXXXXXXXXXXXXX-5' wherein "X"=RNA and "X"=2'-O-methyl RNA. The top strand is the sense strand, and the bottom strand is the antisense strand. In a further related embodiment, the DsiRNA comprises:

5'-XXXXXXXXXXXXXXXXXXXXXXXDD-3'

3'-XXXXXXXXXXXXXXXXXXXXXXXXX-5' wherein "X"=RNA, "X"=2'-O-methyl RNA, and "D"=DNA. The top strand is the sense strand, and the bottom strand is the antisense strand. This modification pattern is also referred to herein as the "AS-M22" or "M22" modification pattern.

In further embodiments, the DsiRNA comprises:

5'-XXXXXXXXXXXXXXXXXXXXXXX-3'

3'-YXXXXXXXXXXXXXXXXXXXXXXXX-5' wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

5'-XXXXXXXXXXXXXXXXXXXXXXXDD-3'

3'-YXXXXXXXXXXXXXXXXXXXXXXXX-5' wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

5'-XXXXXXXXXXXXXXXXXXXXXXX-3'

3'-XXXXXXXXXXXXXXXXXXXXXXXXX-5' wherein "X"=RNA and "X"=2'-O-methyl RNA. The top strand is the sense strand, and the bottom strand is the antisense strand. In a further related embodiment, the DsiRNA comprises:

5'-XXXXXXXXXXXXXXXXXXXXXXXDD-3'

```
3'-XXXXXXXXXXXXXXXXXXXXXXXXXXX-5'
``` wherein "X"=RNA, "X̲"=2'-O-methyl RNA, and "D"=DNA. The top strand is the sense strand, and the bottom strand is the antisense strand. This modification pattern is also referred to herein as the "AS-M24" or "M24" modification pattern.

In additional embodiments, the DsiRNA comprises:

```
5'-XXXXXXXXXXXXXXXXXXXXXXX-3'

3'-YXXXXXXXXXXXXXXXXXXXXXXXXX-5'
``` wherein "X"=RNA, "X̲"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

```
5'-XXXXXXXXXXXXXXXXXXXXXXXDD-3'

3'-YXXXXXXXXXXXXXXXXXXXXXXXXX-5'
``` wherein "X"=RNA, "X̲"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

```
5'-XXXXXXXXXXXXXXXXXXXXXXX-3'

3'-XXXXXXXXXXXXXXXXXXXXXXXXXX-5'
``` wherein "X"=RNA and "X̲"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'

3'-XXXXXXXXXXXXXXXXXXXXXXXXXX-5'
``` wherein "X"=RNA, "X̲"=2'-O-methyl RNA, and "D"=DNA. The top strand is the sense strand, and the bottom strand is the antisense strand. This modification pattern is also referred to herein as the "AS-M25" or "M25" modification pattern.

In further embodiments, the DsiRNA comprises:

```
5'-XXXXXXXXXXXXXXXXXXXXXXX-3'

3'-YXXXXXXXXXXXXXXXXXXXXXXX-5'
``` wherein "X"=RNA, "X̲"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

```
5'-XXXXXXXXXXXXXXXXXXXXXXXDD-3'
``` wherein "X"=RNA, "X̲"=2'-O-methyl RNA, and "D"=DNA. The top strand is the sense strand, and the bottom strand is the antisense strand. This modification pattern is also referred to herein as the "AS-M26" or "M26" modification pattern.

In additional embodiments, the DsiRNA comprises:

```
5'-XXXXXXXXXXXXXXXXXXXXXXX-3'

3'-YXXXXXXXXXXXXXXXXXXXXXXXXX-5'
``` wherein "X"=RNA, "X̲"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

```
5'-XXXXXXXXXXXXXXXXXXXXXXXDD-3'

3'-YXXXXXXXXXXXXXXXXXXXXXXXXX-5'
``` wherein "X"=RNA, "X̲"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

```
5'-XXXXXXXXXXXXXXXXXXXXXXX-3'

3'-XXXXXXXXXXXXXXXXXXXXXXXXXX-5'
``` wherein "X"=RNA and "X̲"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'
```

```
3'-XXXXXXXXXXXXXXXXXXXXXXXXXXXX-5'
``` wherein "X"=RNA, "X̲"=2'-O-methyl RNA, and "D"=DNA. The top strand is the sense strand, and the bottom strand is the antisense strand. This modification pattern is also referred to herein as the "AS-M27" or "M27" modification pattern.

In further embodiments, the DsiRNA comprises:

```
5'-XXXXXXXXXXXXXXXXXXXXXXXXX-3'

3'-YX̲X̲X̲X̲XXXXXXXXXXXXXXXXXXXXXXXXX-5'
``` wherein "X"=RNA, "X̲"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

```
5'-XXXXXXXXXXXXXXXXXXXXXXXXXDD-3'

3'-YX̲X̲X̲X̲XXXXXXXXXXXXXXXXXXXXXXXXX-5'
``` wherein "X"=RNA, "X̲"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

```
5'-XXXXXXXXXXXXXXXXXXXXXXXXX-3'

3'-X̲X̲X̲X̲X̲XXXXXXXXXXXXXXXXXXXXXXXXXX-5'
``` wherein "X"=RNA and "X̲"=2'-O-methyl RNA. The top strand is the sense strand, and the bottom strand is the antisense strand. In a further related embodiment, the DsiRNA comprises:

```
5'-XXXXXXXXXXXXXXXXXXXXXXXXXDD-3'

3'-X̲X̲X̲X̲X̲XXXXXXXXXXXXXXXXXXXXXXXXXX-5'
``` wherein "X"=RNA, "X̲"=2'-O-methyl RNA, and "D"=DNA. The top strand is the sense strand, and the bottom strand is the antisense strand. This modification pattern is also referred to herein as the "AS-M28" or "M28" modification pattern.

In further embodiments, the DsiRNA comprises:

```
5'-XXXXXXXXXXXXXXXXXXXXXXXXX-3'

3'-YX̲X̲X̲X̲XXXXXXXXXXXXXXXXXXXXXXXXX-5'
``` wherein "X"=RNA, "X̲"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

```
5'-XXXXXXXXXXXXXXXXXXXXXXXXXDD-3'
```

```
3'-YXXXXXXXXXXXXXXXXXXXXXXXXXXX-5'
``` wherein "X"=RNA, "X̲"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

```
5'-XXXXXXXXXXXXXXXXXXXXXXXXX-3'

3'-X̲X̲X̲X̲XXXXXXXXXXXXXXXXXXXXXXXXX-5'
``` wherein "X"=RNA and "X̲"=2'-O-methyl RNA. The top strand is the sense strand, and the bottom strand is the antisense strand. In a further related embodiment, the DsiRNA comprises:

```
5'-XXXXXXXXXXXXXXXXXXXXXXXXXDD-3'

3'-X̲X̲X̲X̲XXXXXXXXXXXXXXXXXXXXXXXXX-5'
``` wherein "X"=RNA, "X̲"=2'-O-methyl RNA, and "D"=DNA. The top strand is the sense strand, and the bottom strand is the antisense strand. This modification pattern is also referred to herein as the "AS-M29" or "M29" modification pattern.

In additional embodiments, the DsiRNA comprises:

```
5'-XXXXXXXXXXXXXXXXXXXXXXXXX-3'

3'-X̲X̲X̲X̲X̲XXXXXXXXXXXXXXXXXXXXXXXXXX-5'
``` wherein "X"=RNA and "X̲"=2'-O-methyl RNA. The top strand is the sense strand, and the bottom strand is the antisense strand. In a further related embodiment, the DsiRNA comprises:

```
5'-XXXXXXXXXXXXXXXXXXXXXXXXXDD-3'

3'-X̲X̲X̲X̲X̲XXXXXXXXXXXXXXXXXXXXXXXXXX-5'
``` wherein "X"=RNA, "X̲"=2'-O-methyl RNA, and "D"=DNA. The top strand is the sense strand, and the bottom strand is the antisense strand. This modification pattern is also referred to herein as the "AS-M30" or "M30" modification pattern.

In further embodiments, the DsiRNA comprises:

```
5'-XXXXXXXXXXXXXXXXXXXXXXXXX-3'

3'-X̲X̲X̲X̲X̲XXXXXXXXXXXXXXXXXXXXXXXXXX-5'
``` wherein "X"=RNA and "X̲"=2'-O-methyl RNA. The top strand is the sense strand, and the bottom strand is the antisense strand. In a further related embodiment, the DsiRNA comprises:

```
5'-XXXXXXXXXXXXXXXXXXXXXXXXXDD-3'

3'-X̲X̲X̲X̲X̲XXXXXXXXXXXXXXXXXXXXXXXXXX-5'
``` wherein "X"=RNA, "X̲"=2'-O-methyl RNA, and "D"=DNA. The top strand is the sense strand, and the bottom strand is the antisense strand. This modification pattern is also referred to herein as the "AS-M31" or "M31" modification pattern.

In additional embodiments, the DsiRNA comprises:

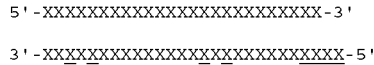

wherein "X"=RNA and "X"=2'-O-methyl RNA. The top strand is the sense strand, and the bottom strand is the antisense strand. In a further related embodiment, the DsiRNA comprises:

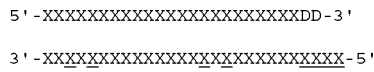

wherein "X"=RNA, "X"=2'-O-methyl RNA, and "D"=DNA. The top strand is the sense strand, and the bottom strand is the antisense strand. This modification pattern is also referred to herein as the "AS-M32" or "M32" modification pattern.

In further embodiments, the DsiRNA comprises:

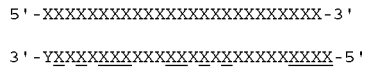

wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

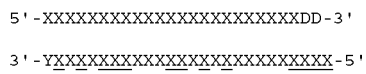

wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

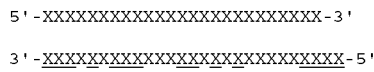

wherein "X"=RNA and "X"=2'-O-methyl RNA. The top strand is the sense strand, and the bottom strand is the antisense strand. In a further related embodiment, the DsiRNA comprises:

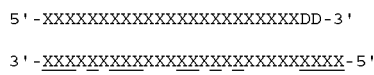

wherein "X"=RNA, "X"=2'-O-methyl RNA, and "D"=DNA. The top strand is the sense strand, and the bottom strand is the antisense strand. This modification pattern is also referred to herein as the "AS-M34" or "M34" modification pattern.

In additional embodiments, the DsiRNA comprises:

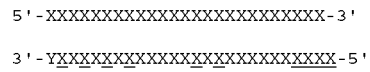

wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

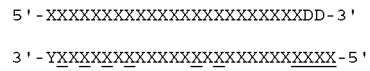

wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

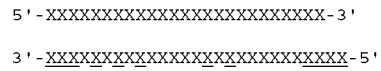

wherein "X"=RNA and "X"=2'-O-methyl RNA. The top strand is the sense strand, and the bottom strand is the antisense strand. In a further related embodiment, the DsiRNA comprises:

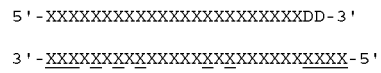

wherein "X"=RNA, "X"=2'-O-methyl RNA, and "D"=DNA. The top strand is the sense strand, and the bottom strand is the antisense strand. This modification pattern is also referred to herein as the "AS-M35" or "M35" modification pattern.

In further embodiments, the DsiRNA comprises:

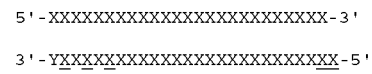

wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

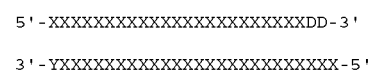

wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

```
5'-XXXXXXXXXXXXXXXXXXXXXXXXX-3'

3'-XXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'

3'-XXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M37" or "M37" modification pattern.

In additional embodiments, the DsiRNA comprises:

```
5'-XXXXXXXXXXXXXXXXXXXXXXXXX-3'

3'-YXXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

```
5'-XXXXXXXXXXXXXXXXXXXXXXXDD-3'

3'-YXXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

```
5'-XXXXXXXXXXXXXXXXXXXXXXXXX-3'

3'-XXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'

3'-XXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M38" or "M38" modification pattern.

In further embodiments, the DsiRNA comprises:

```
5'-XXXXXXXXXXXXXXXXXXXXXXXXX-3'
```

```
3'-YXXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

```
5'-XXXXXXXXXXXXXXXXXXXXXXXDD-3'

3'-YXXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

```
5'-XXXXXXXXXXXXXXXXXXXXXXXXX-3'

3'-XXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'

3'-XXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M40" or "M40" modification pattern.

In additional embodiments, the DsiRNA comprises:

```
5'-XXXXXXXXXXXXXXXXXXXXXXXXX-3'

3'-YXXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

```
5'-XXXXXXXXXXXXXXXXXXXXXXXDD-3'

3'-YXXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

```
5'-XXXXXXXXXXXXXXXXXXXXXXXXX-3'
```

-continued

```
3'-XXXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXXDD-3'

3'-XXXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M41" or "M41" modification pattern.

In further embodiments, the DsiRNA comprises:

```
5'-XXXXXXXXXXXXXXXXXXXXXXXXX-3'

3'-YXXXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

```
5'-XXXXXXXXXXXXXXXXXXXXXXXXDD-3'

3'-YXXXXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

```
5'-XXXXXXXXXXXXXXXXXXXXXXXXX-3'

3'-XXXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXXDD-3'

3'-XXXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M36" or "M36" modification pattern.

In additional embodiments, the DsiRNA comprises:

```
5'-XXXXXXXXXXXXXXXXXXXXXXXXX-3'

3'-YXXXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

```
5'-XXXXXXXXXXXXXXXXXXXXXXXXDD-3'

3'-YXXXXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

```
5'-XXXXXXXXXXXXXXXXXXXXXXXXX-3'

3'-XXXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXXDD-3'

3'-XXXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M42" or "M42" modification pattern.

In further embodiments, the DsiRNA comprises:

```
5'-XXXXXXXXXXXXXXXXXXXXXXXXX-3'

3'-YXXXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

```
5'-XXXXXXXXXXXXXXXXXXXXXXXXDD-3'

3'-YXXXXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

```
5'-XXXXXXXXXXXXXXXXXXXXXXXXX-3'

3'-XXXXXXXXXXXXXXXXXXXXXXXXXXXX-5'
``` wherein "X"=RNA and "X̲"=2'-O-methyl RNA. The top strand is the sense strand, and the bottom strand is the antisense strand. In a further related embodiment, the DsiRNA comprises:

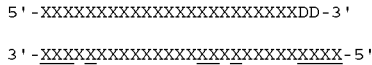

wherein "X"=RNA, "X̲"=2'-O-methyl RNA, and "D"=DNA. The top strand is the sense strand, and the bottom strand is the antisense strand. This modification pattern is also referred to herein as the "AS-M43" or "M43" modification pattern.

In additional embodiments, the DsiRNA comprises:

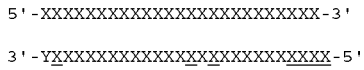

wherein "X"=RNA, "X̲"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

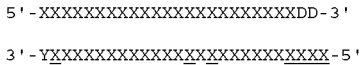

wherein "X"=RNA, "X̲"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

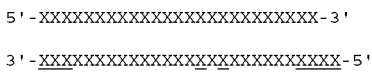

wherein "X"=RNA and "X̲"=2'-O-methyl RNA. The top strand is the sense strand, and the bottom strand is the antisense strand. In a further related embodiment, the DsiRNA comprises:

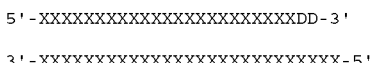

wherein "X"=RNA, "X̲"=2'-O-methyl RNA, and "D"=DNA. The top strand is the sense strand, and the bottom strand is the antisense strand. This modification pattern is also referred to herein as the "AS-M44" or "M44" modification pattern.

In further embodiments, the DsiRNA comprises:

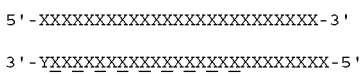

wherein "X"=RNA, "X̲"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

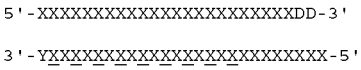

wherein "X"=RNA, "X̲"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

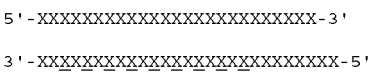

wherein "X"=RNA and "X̲"=2'-O-methyl RNA. The top strand is the sense strand, and the bottom strand is the antisense strand. In a further related embodiment, the DsiRNA comprises:

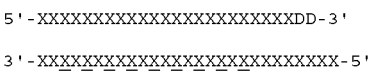

wherein "X"=RNA, "X̲"=2'-O-methyl RNA, and "D"=DNA. The top strand is the sense strand, and the bottom strand is the antisense strand. This modification pattern is also referred to herein as the "AS-M45" or "M45" modification pattern.

In additional embodiments, the DsiRNA comprises:

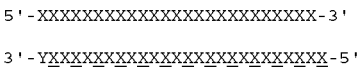

wherein "X"=RNA, "X̲"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

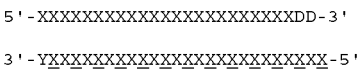

wherein "X"=RNA, "X̲"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

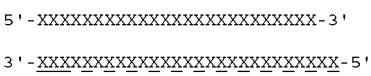

wherein "X"=RNA and "X̲"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'
3'-XXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M46" or "M46" modification pattern.

In further embodiments, the DsiRNA comprises:

```
5'-XXXXXXXXXXXXXXXXXXXXXXXXX-3'
3'-YXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

```
5'-XXXXXXXXXXXXXXXXXXXXXXXDD-3'
3'-YXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

```
5'-XXXXXXXXXXXXXXXXXXXXXXXXX-3'
3'-XXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'
3'-XXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M47" or "M47" modification pattern.

In additional embodiments, the DsiRNA comprises:

```
5'-XXXXXXXXXXXXXXXXXXXXXXXXX-3'
3'-YXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

```
5'-XXXXXXXXXXXXXXXXXXXXXXXDD-3'
3'-YXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

```
5'-XXXXXXXXXXXXXXXXXXXXXXXXX-3'
3'-XXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'
3'-XXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M48" or "M48" modification pattern.

In further embodiments, the DsiRNA comprises:

```
5'-XXXXXXXXXXXXXXXXXXXXXXXXX-3'
3'-YXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

```
5'-XXXXXXXXXXXXXXXXXXXXXXXDD-3'
3'-YXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

```
5'-XXXXXXXXXXXXXXXXXXXXXXXXX-3'
3'-XXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'
```

3'-XXXXXXXXXXXXXXXXXXXXXXXXXX-5' wherein "X"=RNA, "X̲"=2'-O-methyl RNA, and "D"=DNA. The top strand is the sense strand, and the bottom strand is the antisense strand. This modification pattern is also referred to herein as the "AS-M52" or "M52" modification pattern.

In further embodiments, the DsiRNA comprises:

5'-XXXXXXXXXXXXXXXXXXXXXXX-3'

3'-YX̲XX̲XXXXXXXXXXX̲XX̲XXXXXXX̲X̲X̲X̲-5' wherein "X"=RNA, "X̲"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

5'-XXXXXXXXXXXXXXXXXXXXXXXDD-3'

3'-YX̲XX̲XXXXXXXXXXX̲XX̲XXXXXXX̲X̲X̲X̲-5' wherein "X"=RNA, "X̲"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

5'-XXXXXXXXXXXXXXXXXXXXXXXXX-3'

3'-X̲XXX̲XXXXXXXXXXX̲XX̲XXXXXXX̲X̲X̲X̲-5' wherein "X"=RNA and "X̲"=2'-O-methyl RNA. The top strand is the sense strand, and the bottom strand is the antisense strand. In a further related embodiment, the DsiRNA comprises:

5'-XXXXXXXXXXXXXXXXXXXXXXXDD-3'

3'-X̲XXX̲XXXXXXXXXXX̲XX̲XXXXXXX̲X̲X̲X̲-5' wherein "X"=RNA, "X̲"=2'-O-methyl RNA, and "D"=DNA. The top strand is the sense strand, and the bottom strand is the antisense strand. This modification pattern is also referred to herein as the "AS-M54" or "M54" modification pattern.

In additional embodiments, the DsiRNA comprises:

5'-XXXXXXXXXXXXXXXXXXXXXXXXX-3'

3'-YX̲XX̲XXXXXXXXXXX̲XX̲XXXXXXX̲X̲X̲X̲-5' wherein "X"=RNA, "X̲"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

5'-XXXXXXXXXXXXXXXXXXXXXXXDD-3'

3'-YX̲XX̲XXXXXXXXXXX̲XX̲XXXXXXX̲X̲X̲X̲-5' wherein "X"=RNA, "X̲"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. This modification pattern is also referred to herein as the "AS-M55" or "M55" modification pattern.

In further embodiments, the DsiRNA comprises:

5'-XXXXXXXXXXXXXXXXXXXXXXX-3'

3'-YX̲XX̲XXXXXXXXXXX̲XX̲XXXXXXX̲X̲X̲X̲-5' wherein "X"=RNA, "X̲"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

5'-XXXXXXXXXXXXXXXXXXXXXXXDD-3'

3'-YX̲XX̲XXXXXXXXXXX̲XX̲XXXXXXX̲X̲X̲X̲-5' wherein "X"=RNA, "X̲"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

5'-XXXXXXXXXXXXXXXXXXXXXXX-3'

3'-X̲XXX̲XXXXXXXXXXX̲XX̲XXXXXXX̲X̲X̲X̲-5' wherein "X"=RNA and "X̲"=2'-O-methyl RNA. The top strand is the sense strand, and the bottom strand is the antisense strand. In a further related embodiment, the DsiRNA comprises:

5'-XXXXXXXXXXXXXXXXXXXXXXXDD-3'

```
3'-XXXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M56" or "M56" modification pattern.

In additional embodiments, the DsiRNA comprises:

```
5'-XXXXXXXXXXXXXXXXXXXXXXXXX-3'

3'-YXXXXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

```
5'-XXXXXXXXXXXXXXXXXXXXXXXXXDD-3'

3'-YXXXXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

```
5'-XXXXXXXXXXXXXXXXXXXXXXXXX-3'

3'-XXXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXXXDD-3'

3'-XXXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M57" or "M57" modification pattern.

In further embodiments, the DsiRNA comprises:

```
5'-XXXXXXXXXXXXXXXXXXXXXXXXX-3'

3'-YXXXXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

```
5'-XXXXXXXXXXXXXXXXXXXXXXXXXDD-3'
```

```
3'-YXXXXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

```
5'-XXXXXXXXXXXXXXXXXXXXXXXXX-3'

3'-XXXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXXXDD-3'

3'-XXXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M58" or "M58" modification pattern.

In additional embodiments, the DsiRNA comprises:

```
5'-XXXXXXXXXXXXXXXXXXXXXXXXX-3'

3'-YXXXXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

```
5'-XXXXXXXXXXXXXXXXXXXXXXXXXDD-3'

3'-YXXXXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

```
5'-XXXXXXXXXXXXXXXXXXXXXXXXX-3'

3'-XXXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXXXDD-3'
```

```
3'-XXXXXXXXXXXXXXXXXXXXXXXXXXX-5'
``` wherein "X"=RNA, "X̲"=2'-O-methyl RNA, and "D"=DNA. The top strand is the sense strand, and the bottom strand is the antisense strand. This modification pattern is also referred to herein as the "AS-M59" or "M59" modification pattern.

In further embodiments, the DsiRNA comprises:

```
5'-XXXXXXXXXXXXXXXXXXXXXXXXX-3'

3'-YXXXXXXXXXXXXXXXXXXXXXXXXXXX-5'
``` wherein "X"=RNA, "X̲"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

```
5'-XXXXXXXXXXXXXXXXXXXXXXXXXDD-3'

3'-YXXXXXXXXXXXXXXXXXXXXXXXXXXX-5'
``` wherein "X"=RNA, "X̲"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

```
5'-XXXXXXXXXXXXXXXXXXXXXXXXX-3'

3'-XXXXXXXXXXXXXXXXXXXXXXXXXXX-5'
``` wherein "X"=RNA and "X̲"=2'-O-methyl RNA. The top strand is the sense strand, and the bottom strand is the antisense strand. In a further related embodiment, the DsiRNA comprises:

```
5'-XXXXXXXXXXXXXXXXXXXXXXXXXDD-3'

3'-XXXXXXXXXXXXXXXXXXXXXXXXXXX-5'
``` wherein "X"=RNA, "X̲"=2'-O-methyl RNA, and "D"=DNA. The top strand is the sense strand, and the bottom strand is the antisense strand. This modification pattern is also referred to herein as the "AS-M60" or "M60" modification pattern.

In additional embodiments, the DsiRNA comprises:

```
5'-XXXXXXXXXXXXXXXXXXXXXXXXX-3'

3'-YXXXXXXXXXXXXXXXXXXXXXXXXX-5'
``` wherein "X"=RNA, "X̲"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

```
5'-XXXXXXXXXXXXXXXXXXXXXXXXXDD-3'
```

```
3'-YXXXXXXXXXXXXXXXXXXXXXXXXXXX-5'
``` wherein "X"=RNA, "X̲"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

```
5'-XXXXXXXXXXXXXXXXXXXXXXXXX-3'

3'-XXXXXXXXXXXXXXXXXXXXXXXXXXX-5'
``` wherein "X"=RNA and "X̲"=2'-O-methyl RNA. The top strand is the sense strand, and the bottom strand is the antisense strand. In a further related embodiment, the DsiRNA comprises:

```
5'-XXXXXXXXXXXXXXXXXXXXXXXXXDD-3'

3'-XXXXXXXXXXXXXXXXXXXXXXXXXXX-5'
``` wherein "X"=RNA, "X̲"=2'-O-methyl RNA, and "D"=DNA. The top strand is the sense strand, and the bottom strand is the antisense strand. This modification pattern is also referred to herein as the "AS-M61" or "M61" modification pattern.

In further embodiments, the DsiRNA comprises:

```
5'-XXXXXXXXXXXXXXXXXXXXXXXXX-3'

3'-YXXXXXXXXXXXXXXXXXXXXXXXXX-5'
``` wherein "X"=RNA, "X̲"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

```
5'-XXXXXXXXXXXXXXXXXXXXXXXXXDD-3'

3'-YXXXXXXXXXXXXXXXXXXXXXXXXX-5'
``` wherein "X"=RNA, "X̲"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

```
5'-XXXXXXXXXXXXXXXXXXXXXXXXX-3'

3'-XXXXXXXXXXXXXXXXXXXXXXXXXXX-5'
``` wherein "X"=RNA and "X̲"=2'-O-methyl RNA. The top strand is the sense strand, and the bottom strand is the antisense strand. In a further related embodiment, the DsiRNA comprises:

```
5'-XXXXXXXXXXXXXXXXXXXXXXXXXDD-3'
```

```
3'-XXXXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M62" or "M62" modification pattern.

In additional embodiments, the DsiRNA comprises:

```
5'-XXXXXXXXXXXXXXXXXXXXXXXXX-3'

3'-YXXXXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

```
5'-XXXXXXXXXXXXXXXXXXXXXXXXXDD-3'

3'-YXXXXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

```
5'-XXXXXXXXXXXXXXXXXXXXXXXXX-3'

3'-XXXXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXXXDD-3'

3'-XXXXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M63" or "M63" modification pattern.

In further embodiments, the DsiRNA comprises:

```
5'-XXXXXXXXXXXXXXXXXXXXXXXXX-3'

3'-YXXXXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

```
5'-XXXXXXXXXXXXXXXXXXXXXXXXXDD-3'
```

```
3'-YXXXXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

```
5'-XXXXXXXXXXXXXXXXXXXXXXXXX-3'

3'-XXXXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXXXDD-3'

3'-XXXXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M64" or "M64" modification pattern.

In additional embodiments, the DsiRNA comprises:

```
5'-XXXXXXXXXXXXXXXXXXXXXXXXX-3'

3'-YXXXXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

```
5'-XXXXXXXXXXXXXXXXXXXXXXXXXDD-3'

3'-YXXXXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

```
5'-XXXXXXXXXXXXXXXXXXXXXXXXX-3'

3'-XXXXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXXXDD-3'
```

```
3'-XXXXXXXXXXXXXXXXXXXXXXXXXXXXX-5'
``` wherein "X"=RNA, "X̲"=2'-O-methyl RNA, and "D"=DNA. The top strand is the sense strand, and the bottom strand is the antisense strand. This modification pattern is also referred to herein as the "AS-M65" or "M65" modification pattern.

In further embodiments, the DsiRNA comprises:

```
5'-XXXXXXXXXXXXXXXXXXXXXXXXX-3'

3'-YXXXXXXXXXXXXXXXXXXXXXXXXXXX-5'
``` wherein "X"=RNA, "X̲"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

```
5'-XXXXXXXXXXXXXXXXXXXXXXXXXDD-3'

3'-YXXXXXXXXXXXXXXXXXXXXXXXXXXX-5'
``` wherein "X"=RNA, "X̲"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

```
5'-XXXXXXXXXXXXXXXXXXXXXXXXX-3'

3'-XXXXXXXXXXXXXXXXXXXXXXXXXXX-5'
``` wherein "X"=RNA and "X̲"=2'-O-methyl RNA. The top strand is the sense strand, and the bottom strand is the antisense strand. In a further related embodiment, the DsiRNA comprises:

```
5'-XXXXXXXXXXXXXXXXXXXXXXXXXDD-3'

3'-XXXXXXXXXXXXXXXXXXXXXXXXXXX-5'
``` wherein "X"=RNA, "X̲"=2'-O-methyl RNA, and "D"=DNA. The top strand is the sense strand, and the bottom strand is the antisense strand. This modification pattern is also referred to herein as the "AS-M66" or "M66" modification pattern.

In additional embodiments, the DsiRNA comprises:

```
5'-XXXXXXXXXXXXXXXXXXXXXXXXX-3'

3'-YXXXXXXXXXXXXXXXXXXXXXXXXXXX-5'
``` wherein "X"=RNA, "X̲"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

```
5'-XXXXXXXXXXXXXXXXXXXXXXXXXDD-3'
``` wherein "X"=RNA, "X̲"=2'-O-methyl RNA, and "D"=DNA. The top strand is the sense strand, and the bottom strand is the antisense strand. This modification pattern is also referred to herein as the "AS-M67" or "M67" modification pattern.

In further embodiments, the DsiRNA comprises:

```
5'-XXXXXXXXXXXXXXXXXXXXXXXXX-3'

3'-YXXXXXXXXXXXXXXXXXXXXXXXXXXX-5'
``` wherein "X"=RNA, "X̲"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

```
5'-XXXXXXXXXXXXXXXXXXXXXXXXXDD-3'

3'-YXXXXXXXXXXXXXXXXXXXXXXXXXXX-5'
``` wherein "X"=RNA, "X̲"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

```
5'-XXXXXXXXXXXXXXXXXXXXXXXXX-3'

3'-XXXXXXXXXXXXXXXXXXXXXXXXXXX-5'
``` wherein "X"=RNA and "X̲"=2'-O-methyl RNA. The top strand is the sense strand, and the bottom strand is the antisense strand. In a further related embodiment, the DsiRNA comprises:

```
5'-XXXXXXXXXXXXXXXXXXXXXXXXXDD-3'
```

```
3'-XXXXXXXXXXXXXXXXXXXXXXXXXXXX-5'
``` wherein "X"=RNA, "X̲"=2'-O-methyl RNA, and "D"=DNA. The top strand is the sense strand, and the bottom strand is the antisense strand. This modification pattern is also referred to herein as the "AS-M68" or "M68" modification pattern.

In additional embodiments, the DsiRNA comprises:

```
5'-XXXXXXXXXXXXXXXXXXXXXXXXX-3'

3'-YXXXXXXXXXXXXXXXXXXXXXXXXXXXX-5'
``` wherein "X"=RNA, "X̲"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

```
5'-XXXXXXXXXXXXXXXXXXXXXXXXXDD-3'

3'-YXXXXXXXXXXXXXXXXXXXXXXXXXXXX-5'
``` wherein "X"=RNA, "X̲"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

```
5'-XXXXXXXXXXXXXXXXXXXXXXXXX-3'

3'-XXXXXXXXXXXXXXXXXXXXXXXXXXXX-5'
``` wherein "X"=RNA and "X̲"=2'-O-methyl RNA. The top strand is the sense strand, and the bottom strand is the antisense strand. In a further related embodiment, the DsiRNA comprises:

```
5'-XXXXXXXXXXXXXXXXXXXXXXXXXDD-3'

3'-XXXXXXXXXXXXXXXXXXXXXXXXXXXX-5'
``` wherein "X"=RNA, "X̲"=2'-O-methyl RNA, and "D"=DNA. The top strand is the sense strand, and the bottom strand is the antisense strand. This modification pattern is also referred to herein as the "AS-M69" or "M69" modification pattern.

In further embodiments, the DsiRNA comprises:

```
5'-XXXXXXXXXXXXXXXXXXXXXXXXX-3'

3'-YXXXXXXXXXXXXXXXXXXXXXXXXXXXX-5'
``` wherein "X"=RNA, "X̲"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

```
5'-XXXXXXXXXXXXXXXXXXXXXXXXXDD-3'
```

```
3'-YXXXXXXXXXXXXXXXXXXXXXXXXXXXX-5'
``` wherein "X"=RNA, "X̲"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

```
5'-XXXXXXXXXXXXXXXXXXXXXXXXX-3'

3'-XXXXXXXXXXXXXXXXXXXXXXXXXXXX-5'
``` wherein "X"=RNA and "X̲"=2'-O-methyl RNA. The top strand is the sense strand, and the bottom strand is the antisense strand. In a further related embodiment, the DsiRNA comprises:

```
5'-XXXXXXXXXXXXXXXXXXXXXXXXXDD-3'

3'-XXXXXXXXXXXXXXXXXXXXXXXXXXXX-5'
``` wherein "X"=RNA, "X̲"=2'-O-methyl RNA, and "D"=DNA. The top strand is the sense strand, and the bottom strand is the antisense strand. This modification pattern is also referred to herein as the "AS-M70" or "M70" modification pattern.

In additional embodiments, the DsiRNA comprises:

```
5'-XXXXXXXXXXXXXXXXXXXXXXXXX-3'

3'-YXXXXXXXXXXXXXXXXXXXXXXXXXXXX-5'
``` wherein "X"=RNA, "X̲"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

```
5'-XXXXXXXXXXXXXXXXXXXXXXXXX-3'

3'-YXXXXXXXXXXXXXXXXXXXXXXXXXXXX-5'
``` wherein "X"=RNA, "X̲"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

```
5'-XXXXXXXXXXXXXXXXXXXXXXXXX-3'

3'-XXXXXXXXXXXXXXXXXXXXXXXXXXXX-5'
``` wherein "X"=RNA and "X̲"=2'-O-methyl RNA. The top strand is the sense strand, and the bottom strand is the antisense strand. In a further related embodiment, the DsiRNA comprises:

```
5'-XXXXXXXXXXXXXXXXXXXXXXXXX-3'
```

3'-XXXXXXXXXXXXXXXXXXXXXXXXXXXXX-5' wherein "X"=RNA, "X̲"=2'-O-methyl RNA, and "D"=DNA. The top strand is the sense strand, and the bottom strand is the antisense strand. This modification pattern is also referred to herein as the "AS-M71" or "M71" modification pattern.

In further embodiments, the DsiRNA comprises:

5'-XXXXXXXXXXXXXXXXXXXXXXXXX-3'

3'-YXXXXXXXXXXXXXXXXXXXXXXXXXXXXX-5' wherein "X"=RNA, "X̲"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

5'-XXXXXXXXXXXXXXXXXXXXXXXXXDD-3'

3'-YXXXXXXXXXXXXXXXXXXXXXXXXXXXXX-5' wherein "X"=RNA, "X̲"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

5'-XXXXXXXXXXXXXXXXXXXXXXXXX-3'

3'-XXXXXXXXXXXXXXXXXXXXXXXXXXXXX-5' wherein "X"=RNA and "X̲"=2'-O-methyl RNA. The top strand is the sense strand, and the bottom strand is the antisense strand. In a further related embodiment, the DsiRNA comprises:

5'-XXXXXXXXXXXXXXXXXXXXXXXXXDD-3'

3'-XXXXXXXXXXXXXXXXXXXXXXXXXXXXX-5' wherein "X"=RNA, "X̲"=2'-O-methyl RNA, and "D"=DNA. The top strand is the sense strand, and the bottom strand is the antisense strand. This modification pattern is also referred to herein as the "AS-M72" or "M72" modification pattern.

In additional embodiments, the DsiRNA comprises:

5'-XXXXXXXXXXXXXXXXXXXXXXXXX-3'

3'-YXXXXXXXXXXXXXXXXXXXXXXXXXXXXX-5' wherein "X"=RNA, "X̲"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

5'-XXXXXXXXXXXXXXXXXXXXXXXXXDD-3'

3'-YXXXXXXXXXXXXXXXXXXXXXXXXXXXXX-5' wherein "X"=RNA, "X̲"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

5'-XXXXXXXXXXXXXXXXXXXXXXXXX-3'

3'-XXXXXXXXXXXXXXXXXXXXXXXXXXXXX-5' wherein "X"=RNA and "X̲"=2'-O-methyl RNA. The top strand is the sense strand, and the bottom strand is the antisense strand. In a further related embodiment, the DsiRNA comprises:

5'-XXXXXXXXXXXXXXXXXXXXXXXXXDD-3'

3'-XXXXXXXXXXXXXXXXXXXXXXXXXXXXX-5' wherein "X"=RNA, "X̲"=2'-O-methyl RNA, and "D"=DNA. The top strand is the sense strand, and the bottom strand is the antisense strand. This modification pattern is also referred to herein as the "AS-M73" or "M73" modification pattern.

In additional embodiments, the DsiRNA comprises:

5'-XXXXXXXXXXXXXXXXXXXXXXXXX-3'

3'-XXXXXXXXXXXXXXXXXXXXXXXXXXXXX-5' wherein "X"=RNA and "X̲"=2'-O-methyl RNA. In a further related embodiment, the DsiRNA comprises:

5'-XXXXXXXXXXXXXXXXXXXXXXXXXDD-3'

3'-XXXXXXXXXXXXXXXXXXXXXXXXXXXXX-5' wherein "X"=RNA, "X̲"=2'-O-methyl RNA, and "D"=DNA. The top strand is the sense strand, and the bottom strand is the antisense strand. This modification pattern is also referred to herein as the "AS-M7*" or "M7*" modification pattern.

In further embodiments, the DsiRNA comprises:

5'-XXXXXXXXXXXXXXXXXXXXXXXXX-3'

3'-XXXXXXXXXXXXXXXXXXXXXXXXXXXXX-5' wherein "X"=RNA and "X̲"=2'-O-methyl RNA. The top strand is the sense strand, and the bottom strand is the antisense strand. In a further related embodiment, the DsiRNA comprises:

5'-XXXXXXXXXXXXXXXXXXXXXXXXXDD-3'

3'-XXXXXXXXXXXXXXXXXXXXXXXXXXXXX-5' wherein "X"=RNA, "X̲"=2'-O-methyl RNA, and "D"=DNA. The top strand is the sense strand, and the bottom strand is the antisense strand. This modification pattern is also referred to herein as the "AS-M6*" or "M6*" modification pattern.

In other embodiments, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X"=2'-O-methyl RNA. The top strand is the sense strand, and the bottom strand is the antisense strand. In another related embodiment, the DsiRNA comprises:

```
5'-XXXXXXXXXXXXXXXXXXXXXXXDD-3'
3'-XXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M5*" or "M5*" modification pattern.

In further embodiments, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'
3'-XXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M4*" or "M4*" modification pattern.

In additional embodiments, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'
3'-XXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M8*" or "M8*" modification pattern.

In additional embodiments, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'
3'-XXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M2*" or "M2*" modification pattern.

In other embodiments, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'
3'-XXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M10*" or "M10*" modification pattern.

In further embodiments, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'
3'-XXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M11*" or "M11*" modification pattern.

In further embodiments, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'
```

-continued

```
3'-XXXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M13*" or "M13*" modification pattern.

In further embodiments, the DsiRNA comprises:

```
5'-XXXXXXXXXXXXXXXXXXXXXXX-3'

3'-XXXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXDD-3'

3'-XXXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M14*" or "M14*" modification pattern.

In additional embodiments, the DsiRNA comprises:

```
5'-XXXXXXXXXXXXXXXXXXXXXXX-3'

3'-XXXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXDD-3'

3'-XXXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M15*" or "M15*" modification pattern.

In further embodiments, the DsiRNA comprises:

```
5'-XXXXXXXXXXXXXXXXXXXXXXX-3'

3'-XXXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXDD-3'

3'-XXXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M16*" or "M16*" modification pattern.

In additional embodiments, the DsiRNA comprises:

```
5'-XXXXXXXXXXXXXXXXXXXXXXX-3'

3'-XXXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXDD-3'

3'-XXXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M17*" or "M17*" modification pattern.

In further embodiments, the DsiRNA comprises:

```
5'-XXXXXXXXXXXXXXXXXXXXXXX-3'

3'-XXXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXDD-3'

3'-XXXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M18*" or "M18*" modification pattern.

In additional embodiments, the DsiRNA comprises:

```
5'-XXXXXXXXXXXXXXXXXXXXXXX-3'

3'-XXXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXDD-3'

3'-XXXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M19*" or "M19*" modification pattern.

In further embodiments, the DsiRNA comprises:

```
5'-XXXXXXXXXXXXXXXXXXXXXDD-3'
```

3'-YXXXXXXXXXXXXXXXXXXXXXXXXX-5' wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

5'-XXXXXXXXXXXXXXXXXXXXXXXXX-3'

3'-XXXXXXXXXXXXXXXXXXXXXXXXXX-5' wherein "X"=RNA and "X"=2'-O-methyl RNA. The top strand is the sense strand, and the bottom strand is the antisense strand. In a further related embodiment, the DsiRNA comprises:

5'-XXXXXXXXXXXXXXXXXXXXXXXDD-3'

3'-XXXXXXXXXXXXXXXXXXXXXXXXXX-5' wherein "X"=RNA, "X"=2'-O-methyl RNA, and "D"=DNA. The top strand is the sense strand, and the bottom strand is the antisense strand. This modification pattern is also referred to herein as the "AS-M20*" or "M20*" modification pattern.

In additional embodiments, the DsiRNA comprises:

5'-XXXXXXXXXXXXXXXXXXXXXXXXX-3'

3'-XXXXXXXXXXXXXXXXXXXXXXXXXX-5' wherein "X"=RNA and "X"=2'-O-methyl RNA. The top strand is the sense strand, and the bottom strand is the antisense strand. In a further related embodiment, the DsiRNA comprises:

5'-XXXXXXXXXXXXXXXXXXXXXXXDD-3'

3'-XXXXXXXXXXXXXXXXXXXXXXXXXX-5' wherein "X"=RNA, "X"=2'-O-methyl RNA, and "D"=DNA. The top strand is the sense strand, and the bottom strand is the antisense strand. This modification pattern is also referred to herein as the "AS-M22*" or "M22*" modification pattern.

In further embodiments, the DsiRNA comprises:

5'-XXXXXXXXXXXXXXXXXXXXXXXXX-3'

3'-XXXXXXXXXXXXXXXXXXXXXXXXXX-5' wherein "X"=RNA and "X"=2'-O-methyl RNA. The top strand is the sense strand, and the bottom strand is the antisense strand. In a further related embodiment, the DsiRNA comprises:

5'-XXXXXXXXXXXXXXXXXXXXXXXDD-3'

3'-XXXXXXXXXXXXXXXXXXXXXXXXXX-5' wherein "X"=RNA, "X"=2'-O-methyl RNA, and "D"=DNA. The top strand is the sense strand, and the bottom strand is the antisense strand. This modification pattern is also referred to herein as the "AS-M24*" or "M24*" modification pattern.

In additional embodiments, the DsiRNA comprises:

5'-XXXXXXXXXXXXXXXXXXXXXXXXX-3'

3'-XXXXXXXXXXXXXXXXXXXXXXXXXX-5' wherein "X"=RNA and "X"=2'-O-methyl RNA. The top strand is the sense strand, and the bottom strand is the antisense strand. In a further related embodiment, the DsiRNA comprises:

5'-XXXXXXXXXXXXXXXXXXXXXXXDD-3'

3'-XXXXXXXXXXXXXXXXXXXXXXXXXX-5' wherein "X"=RNA, "X"=2'-O-methyl RNA, and "D"=DNA. The top strand is the sense strand, and the bottom strand is the antisense strand. This modification pattern is also referred to herein as the "AS-M25*" or "M25*" modification pattern.

In further embodiments, the DsiRNA comprises:

5'-XXXXXXXXXXXXXXXXXXXXXXXXX-3'

3'-XXXXXXXXXXXXXXXXXXXXXXXXXX-5' wherein "X"=RNA and "X"=2'-O-methyl RNA. The top strand is the sense strand, and the bottom strand is the antisense strand. In a further related embodiment, the DsiRNA comprises:

5'-XXXXXXXXXXXXXXXXXXXXXXXDD-3'

3'-XXXXXXXXXXXXXXXXXXXXXXXXXX-5' wherein "X"=RNA, "X"=2'-O-methyl RNA, and "D"=DNA. The top strand is the sense strand, and the bottom strand is the antisense strand. This modification pattern is also referred to herein as the "AS-M26*" or "M26*" modification pattern.

In additional embodiments, the DsiRNA comprises:

5'-XXXXXXXXXXXXXXXXXXXXXXXXX-3'

3'-XXXXXXXXXXXXXXXXXXXXXXXXXX-5' wherein "X"=RNA and "X"=2'-O-methyl RNA. The top strand is the sense strand, and the bottom strand is the antisense strand. In a further related embodiment, the DsiRNA comprises:

5'-XXXXXXXXXXXXXXXXXXXXXXXDD-3'

3'-XXXXXXXXXXXXXXXXXXXXXXXXXX-5' wherein "X"=RNA, "X"=2'-O-methyl RNA, and "D"=DNA. The top strand is the sense strand, and the bottom strand is the antisense strand. This modification pattern is also referred to herein as the "AS-M27*" or "M27*" modification pattern.

In additional embodiments, the DsiRNA comprises:

5'-XXXXXXXXXXXXXXXXXXXXXXXXX-3'

```
3'-XXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'
3'-XXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M28*" or "M28*" modification pattern.

In further embodiments, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'
3'-XXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M29*" or "M29*" modification pattern.

In additional embodiments, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'
3'-XXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M34*" or "M34*" modification pattern.

In further embodiments, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'
3'-XXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M35*" or "M35*" modification pattern.

In additional embodiments, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'
3'-XXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M37*" or "M37*" modification pattern.

In further embodiments, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'
3'-XXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M38*" or "M38*" modification pattern.

In further embodiments, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'
3'-XXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M40*" or "M40*" modification pattern.

In additional embodiments, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'
3'-XXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M41*" or "M41*" modification pattern.

In further embodiments, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'
3'-XXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M36*" or "M36*" modification pattern.

In additional embodiments, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'
3'-XXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M42*" or "M42*" modification pattern.

In further embodiments, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'
3'-XXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M43*" or "M43*" modification pattern.

In additional embodiments, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'
3'-XXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M44*" or "M44*" modification pattern.

In further embodiments, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'
3'-XXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M46*" or "M46*" modification pattern.

In additional embodiments, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXXXDD-3'
3'-XXXXXXXXXXXXXXXXXXXXXXXXXXX-5'
``` wherein "X"=RNA, "X̲"=2'-O-methyl RNA, and "D"=DNA. The top strand is the sense strand, and the bottom strand is the antisense strand. This modification pattern is also referred to herein as the "AS-M47*" or "M47*" modification pattern.

In further embodiments, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X̲"=2'-O-methyl RNA. The top strand is the sense strand, and the bottom strand is the antisense strand. In a further related embodiment, the DsiRNA comprises:

```
5'-XXXXXXXXXXXXXXXXXXXXXXXXXDD-3'
3'-XXXXXXXXXXXXXXXXXXXXXXXXXXX-5'
``` wherein "X"=RNA, "X̲"=2'-O-methyl RNA, and "D"=DNA. The top strand is the sense strand, and the bottom strand is the antisense strand. This modification pattern is also referred to herein as the "AS-M48*" or "M48*" modification pattern.

In additional embodiments, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X̲"=2'-O-methyl RNA. The top strand is the sense strand, and the bottom strand is the antisense strand. In a further related embodiment, the DsiRNA comprises:

```
5'-XXXXXXXXXXXXXXXXXXXXXXXXXDD-3'
3'-XXXXXXXXXXXXXXXXXXXXXXXXXXX-5'
``` wherein "X"=RNA, "X̲"=2'-O-methyl RNA, and "D"=DNA. The top strand is the sense strand, and the bottom strand is the antisense strand. This modification pattern is also referred to herein as the "AS-M52*" or "M52*" modification pattern.

In further embodiments, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X̲"=2'-O-methyl RNA. The top strand is the sense strand, and the bottom strand is the antisense strand. In a further related embodiment, the DsiRNA comprises:

```
5'-XXXXXXXXXXXXXXXXXXXXXXXXXDD-3'
3'-XXXXXXXXXXXXXXXXXXXXXXXXXXX-5'
``` wherein "X"=RNA, "X̲"=2'-O-methyl RNA, and "D"=DNA. The top strand is the sense strand, and the bottom strand is the antisense strand. This modification pattern is also referred to herein as the "AS-M54*" or "M54*" modification pattern.

In additional embodiments, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X̲"=2'-O-methyl RNA. The top strand is the sense strand, and the bottom strand is the antisense strand. In a further related embodiment, the DsiRNA comprises:

```
5'-XXXXXXXXXXXXXXXXXXXXXXXXXDD-3'
3'-XXXXXXXXXXXXXXXXXXXXXXXXXXX-5'
``` wherein "X"=RNA, "X̲"=2'-O-methyl RNA, and "D"=DNA. The top strand is the sense strand, and the bottom strand is the antisense strand. This modification pattern is also referred to herein as the "AS-M55*" or "M55*" modification pattern.

In further embodiments, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X̲"=2'-O-methyl RNA. The top strand is the sense strand, and the bottom strand is the antisense strand. In a further related embodiment, the DsiRNA comprises:

```
5'-XXXXXXXXXXXXXXXXXXXXXXXXXDD-3'
3'-XXXXXXXXXXXXXXXXXXXXXXXXXXX-5'
``` wherein "X"=RNA, "X̲"=2'-O-methyl RNA, and "D"=DNA. The top strand is the sense strand, and the bottom strand is the antisense strand. This modification pattern is also referred to herein as the "AS-M56*" or "M56*" modification pattern.

In additional embodiments, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X̲"=2'-O-methyl RNA. The top strand is the sense strand, and the bottom strand is the antisense strand. In a further related embodiment, the DsiRNA comprises:

```
5'-XXXXXXXXXXXXXXXXXXXXXXXXXDD-3'
3'-XXXXXXXXXXXXXXXXXXXXXXXXXXX-5'
``` wherein "X"=RNA, "X̲"=2'-O-methyl RNA, and "D"=DNA. The top strand is the sense strand, and the bottom strand is the antisense strand. This modification pattern is also referred to herein as the "AS-M57*" or "M57*" modification pattern.

In further embodiments, the DsiRNA comprises:

```
5'-XXXXXXXXXXXXXXXXXXXXXXXXX-3'
```

```
3'-XXXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'

3'-XXXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M58*" or "M58*" modification pattern.

In additional embodiments, the DsiRNA comprises:

```
5'-XXXXXXXXXXXXXXXXXXXXXXXXX-3'

3'-XXXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'

3'-XXXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M59*" or "M59*" modification pattern.

In further embodiments, the DsiRNA comprises:

```
5'-XXXXXXXXXXXXXXXXXXXXXXXXX-3'

3'-XXXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'

3'-XXXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M60*" or "M60*" modification pattern.

In additional embodiments, the DsiRNA comprises:

```
5'-XXXXXXXXXXXXXXXXXXXXXXXXX-3'

3'-XXXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'

3'-XXXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M61*" or "M61*" modification pattern.

In further embodiments, the DsiRNA comprises:

```
5'-XXXXXXXXXXXXXXXXXXXXXXXXX-3'

3'-XXXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'

3'-XXXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M62*" or "M62*" modification pattern.

In additional embodiments, the DsiRNA comprises:

```
5'-XXXXXXXXXXXXXXXXXXXXXXXXX-3'

3'-XXXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'

3'-XXXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M63*" or "M63*" modification pattern.

In further embodiments, the DsiRNA comprises:

```
5'-XXXXXXXXXXXXXXXXXXXXXXXXX-3'

3'-XXXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'

3'-XXXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M64*" or "M64*" modification pattern.

In additional embodiments, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'
3'-XXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M65*" or "M65*" modification pattern.

In further embodiments, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'
3'-XXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M66*" or "M66*" modification pattern.

In additional embodiments, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'
3'-XXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M67*" or "M67*" modification pattern.

In further embodiments, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'
3'-XXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M68*" or "M68*" modification pattern.

In additional embodiments, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'
3'-XXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M69*" or "M69*" modification pattern.

In further embodiments, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'
3'-XXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M70*" or "M70*" modification pattern.

In additional embodiments, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXXXDD-3'
3'-XXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M71*" or "M71*" modification pattern.

In further embodiments, the DsiRNA comprises:

```
5'-XXXXXXXXXXXXXXXXXXXXXXXXXXX-3'
3'-XXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXXXDD-3'
3'-XXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M72*" or "M72*" modification pattern.

In additional embodiments, the DsiRNA comprises:

```
5'-XXXXXXXXXXXXXXXXXXXXXXXXXXX-3'
3'-XXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXXXDD-3'
3'-XXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M73*" or "M73*" modification pattern.

Additional exemplary antisense strand modifications include the following:

```
3'-XXXXXXXXXXXXXXXXXXXXXXXXXXX-5'      "AS-M74"
3'-XXXXXXXXXXXXXXXXXXXXXXXXXXX-5'      "AS-M75"
3'-XXXXXXXXXXXXXXXXXXXXXXXXXXX-5'      "AS-M76"
3'-XXXXXXXXXXXXXXXXXXXXXXXXXXX-5'      "AS-M77"
3'-XXXXXXXXXXXXXXXXXXXXXXXXXXX-5'      "AS-M78"
3'-XXXXXXXXXXXXXXXXXXXXXXXXXXX-5'      "AS-M79"
3'-XXXXXXXXXXXXXXXXXXXXXXXXXXX-5'      "AS-M80"
3'-XXXXXXXXXXXXXXXXXXXXXXXXXXX-5'      "AS-M81"
```

-continued
```
3'-XpXXXXXXXXXXXXXXXXXXXXXXXXXX-5'     "AS-M82"
3'-XpXXXXXXXXXXXXXXXXXXXXXXXXXX-5'     "AS-M83"
3'-XXXXXXXXXXXXXXXXXXXXXXXXXXX-5'      "AS-M84"
3'-XXXXXXXXXXXXXXXXXXXXXXXXXXX-5'      "AS-M85"
3'-FFFXXXXXXXXXXXXXXXXXXXXFFFF-5'      "AS-M88"
3'-XXXXFXXFXFXXXXXXXXXXXXXXXX-5'       "AS-M89"
3'-FFFXFXFXFXFXFXFXXXXXXXFFFF-5'       "AS-M90"
3'-FFFXXXXXXXXXXXXXXXXXXXXXFF-5'       "AS-M91"
3'-XXXXXFXXXXXFXFXXXXXXXXXXXX-5'       "AS-M92"
3'-FFFXFXXXXXXXXXXFXXXXXXXX-5'         "AS-M93"
3'-FFFXFXFXXXXXFXFXFXXXXFFFF-5'        "AS-M94"
3'-FFFXFXFXFXFXFXFXXXXXXXFFFF-5'       "AS-M95"
3'-FFFXFXFXFXFXFXFXXXXXXXFFFpF-5'      "AS-M96"
3'-XXXXXXXXXXXXXXXXXXXXXXXXXXX-5'      "AS-M210"
3'-XXXXXXXXXXXXXXXXXXXXXXXXXXX-5'      "AS-M74*"
3'-XXXXXXXXXXXXXXXXXXXXXXXXXXX-5'      "AS-M75*"
3'-XXXXXXXXXXXXXXXXXXXXXXXXXXX-5'      "AS-M76*"
3'-XXXXXXXXXXXXXXXXXXXXXXXXXXX-5'      "AS-M77*"
3'-XXXXXXXXXXXXXXXXXXXXXXXXXXX-5'      "AS-M78*"
3'-XXXXXXXXXXXXXXXXXXXXXXXXXXX-5'      "AS-M79*"
3'-XXXXXXXXXXXXXXXXXXXXXXXXXXX-5'      "AS-M80*"
3'-XpXXXXXXXXXXXXXXXXXXXXXXXXXX-5'     "AS-M82*"
3'-XpXXXXXXXXXXXXXXXXXXXXXXXXXX-5'     "AS-M83*"
3'-XXXXXXXXXXXXXXXXXXXXXXXXXXX-5'      "AS-M84*"
3'-XFFXXXXXXXXXXXXXXXXXXXFFFF-5'       "AS-M88*"
3'-XXXXFXXXFXFXXXXXXXXXXXXXXX-5'       "AS-M89*"
3'-XFFXFXFXFXFXFXFXXXXXXXFFFF-5'       "AS-M90*"
3'-XFFXXXXXXXXXXXXXXXXXXXXXFF-5'       "AS-M91*"
3'-XXXXXFXXXXXFXFXXXXXXXXXXXX-5'       "AS-M92*"
3'-XFFXFXXXXXXXXXXFXXXXXXXX-5'         "AS-M93*"
3'-XFFXFXFXXXXXFXFXFXXXXFFFF-5'        "AS-M94*"
3'-XFFXFXFXFXFXFXFXXXXXXXFFFF-5'       "AS-M95*"
3'-XFFXFXFXFXFXFXFXXXXXXXFFFpF-5'      "AS-M96*"
3'-XXXXXXXXXXXXXXXXXXXXXXXXXXX-5'      "AS-M210*"
3'-XpXXXXXXXXXXXXXXXXXXXXXXXpX-5'      "AS-M101"
3'-XpXXXXXXXXXXXXXXXXXXXXXXXpX-5'      "AS-M104"
3'-XpXXXXXXXXXXXXXXXXXXXXXXXpX-5'      "AS-M104*"
3'-XpFpXFXFXFXFXFXFXFXFFXXXpX-5'       "AS-M105"
3'-XpFpXFXFXFXFXFXFXFXFFXXXpX-5'       "AS-M105*"
3'-XpXXXXXXXXXXXXXXXXXXXXXXXpX-5'      "AS-M106"
3'-XpXXXXXXXXXXXXXXXXXXXXXXXpX-5'      "AS-M106*"
```

-continued

| | |
|---|---|
| 3'-XXpXXXXXXXXXXXXXXXXXXXXXXXX-5' | "AS-M107" |
| 3'-XXpXXXXXXXXXXXXXXXXXXXXXXXX-5' | "AS-M107*" |
| 3'-ba-XXXXXXXXXXXXXXXXXXXXXXXXXXX-5'<br>(ba = inverted abasic for F7<br>stabilization at 3' end) | "AS-M108" |
| 3'-ba-XXXXXXXXXXXXXXXXXXXXXXXXXXX-5'<br>(ba = inverted abasic for F7<br>stabilization at 3' end) | "AS-M108*" |
| 3'-XDXXXXXXXXXXXXXXXXXXXXXXXXX-5' | "AS-M109" |
| 3'-XpXXFXFXFXXXXXXXXXXXXXXXXXpX-5' | "AS-M110" |
| 3'-XpXXFXFXFXXXXXXXXXXXXXXXXXpX-5' | "AS-M110*" |
| 3'-XpXXFXFXFXXXXFXFXFXXXXXXXpX-5' | "AS-M111" |
| 3'-XpXXFXFXFFXXXXXXXXXFXXXXXXpX-5' | "AS-M112" |
| 3'-XpXXFXFXFFXXFXXXXXXXFXXXXXXpX-5' | "AS-M113" |
| 3'-XpXXFXFXFFFFFXXXXXXXFXXXXXXpX-5' | "AS-M114" |
| 3'-XpXXFXFXFFFFFXXXXXXXFXXFXXXpX-5' | "AS-M115" |
| 3'-XpXXFXFXFFFFFXXXXXXXFFFXXXpX-5' | "AS-M116" |
| 3'-XpFXFXFXFXFXFXFXFXFXFXFXFpX-5' | "AS-M117" |
| 3'-XpXXFXFXFXXXXFXFXFXXXXXXXpX-5' | "AS-M111*" |
| 3'-XpXXFXFXFFXXXXXXXXXFXXXXXXpX-5' | "AS-M112*" |
| 3'-XpXXFXFXFFXFXXXXXXXFXXXXXpX-5' | "AS-M113*" |
| 3'-XpXXFXFXFFFFFXXXXXXXFXXXXXXpX-5' | "AS-M114*" |
| 3'-XpXXFXFXFFFFFXXXXXXXFXXFXXXpX-5' | "AS-M115*" |
| 3'-XpXXFXFXFFFFFXXXXXXXFFFXXXpX-5' | "AS-M116*" |
| 3'-XpFXFXFXFXFXFXFXFXFXFXFXFpX-5' | "AS-M117*" |
| 3'-XpXXXXXXXXXXXXXXXXXXXXXXXXpX-5' | "AS-M120" |
| 3'-XpXXXXXXXXXXXXXXXXXXXXXXXXpX-5' | "AS-M121" |
| 3'-XpXXXXXXXXXXXXXXXXXXXXXXXXpX-5' | "AS-M122" |
| 3'-XpXXXXXXXXXXXXXXXXXXXXXXXXpX-5' | "AS-M123" |
| 3'-XpXXXXXXXXXXXXXXXXXXXXXXXXpX-5' | "AS-M124" |
| 3'-XpXXXXXXXXXXXXXXXXXXXXXXXXpX-5' | "AS-M125" |
| 3'-XpFpXFXFXFXXXXXFXFXFXXXXFXpX-5' | "AS-M126" |
| 3'-XpFpXFXFXFXXXXXFXFXFXXXXFXpX-5' | "AS-M127" |
| 3'-XpFpXFXFXFXFXFXFXFXFXFFXXXpX-5' | "AS-M128" |
| 3'-XpFpXFXFXFXFXFXFXFXFXFXFFFFFpF-5' | "AS-M129" |
| 3'-XpFpXFXFXFXFXFXFXFXFXFXFXXXFXpX-5' | "AS-M130" |
| 3'-XpFpXFXFXFXFXFXFXFXFXFXFXFXFpX-5' | "AS-M131" |
| 3'-XpFpXFXFXFXFXFXFXFXFXFXFXXXpX-5' | "AS-M132" |
| 3'-XpFpXFXFXFXFXFXFXFXFXFXFXXXXpX-5' | "AS-M133" |
| 3'-XpFpXFXFXFXFXFXFXFXFXFXFFFpF-5' | "AS-M134" |
| 3'-XXXXXXXXXXXXXXXXXXXXXXXXXX-5' | "AS-M135" |
| 3'-XXXXXXXXXXXXXXXXXXXXXXXXXX-5' | "AS-M136" |
| 3'-XXXXXXXXXXXXXXXXXXXXXXXXXX-5' | "AS-M137" |
| 3'-XXXFXFXFXXXXXXFXFXFXXXXXXX-5' | "AS-M138" |
| 3'-XXXFXFXFFXXXXXXXXFXXXXXXX-5' | "AS-M139" |
| 3'-XpXXFXFXFXXXXXFXFXFFFXXXXXpX-5' | "AS-M140" |
| 3'-XpXXFXFXFFXXXFFXFXFFFXXXXpX-5' | "AS-M141" |
| 3'-XpXXFXFXFXFXFXFXFXFFFXXXXXpX-5' | "AS-M142" |
| 3'-XpXXFXFXFFFFFFFFXFXFFFXXXXpX-5' | "AS-M143" |
| 3'-XpXXFXFXFXFXFXFXFXFXFpXpFpXXXXXpX-5' | "AS-M144" |
| 3'-XXXXXXXXXXXXXXXXFXXXXXXXXX-5' | "AS-M145" |
| 3'-XXXXXXXXXXXXXXFXXXXXXXXXXX-5' | "AS-M146" |
| 3'-XXXXXXFXXXXXXXXXXXXXXXXXXX-5' | "AS-M147" |
| 3'-XXXXXXXXXXFXXXXXXXXXXXXXX-5' | "AS-M148" |
| 3'-XXXXXXXXXXXFXXXXXXXXXXXXXX-5' | "AS-M149" |
| 3'-XXXXXXXXXXXXFXXXXXXXXXXXXX-5' | "AS-M150" |
| 3'-XXXXXXXXXXXXFXXXFXXXXXXXXX-5' | "AS-M151" |
| 3'-XXXXXXXXXXXXFXXFXXXXXXXXXX-5' | "AS-M152" |
| 3'-XXXXXXXXFXXXXXXXXXXXXXXXXX-5' | "AS-M153" |
| 3'-XXXXXXXXFXXXXXXXXXXXXXXXXX-5' | "AS-M154" |
| 3'-XXXXXXFXXXXXXXXXXXXXXXXXXX-5' | "AS-M155" |
| 3'-XpXXXXXXXXXXXXXXXXXXXXXXXXXXpX-5' | "AS-M156" |
| 3'-XpXXXXXXXXXXXXXXXXXXXXXXXXXXpX-5' | "AS-M157" |
| 3'-XpXXFFFFXXXFXXFFXXXXXXXpX-5' | "AS-M158" |
| 3'-XpXXFFFFFFFFXXFXXFFXXXXXXpX-5' | "AS-M159" |
| 3'-XpXXFXXXFXXXXXFXXFFXXXXXXpX-5' | "AS-M160" |
| 3'-XpXXFXXXFXFXFXFXXFFXXXXXXpX-5' | "AS-M161" |
| 3'-XXXXXXXXXFXFXFXXXXXXXXXXX-5' | "AS-M162" |
| 3'-XXXXXXXXXXXXXXXXXXXXXXXXX-5' | "AS-M163" |
| 3'-XXXXXXXXDXXXXXXXXXXXXXXXXX-5' | "AS-M164" |
| 3'-XpXXXXXXXXXXXXXXXXXXXXXXXXpX-5' | "AS-M120*" |
| 3'-XpXXXXXXXXXXXXXXXXXXXXXXXXpX-5' | "AS-M121*" |
| 3'-XpXXXXXXXXXXXXXXXXXXXXXXXXpX-5' | "AS-M122*" |
| 3'-XpXXXXXXXXXXXXXXXXXXXXXXXXpX-5' | "AS-M123*" |
| 3'-XpXXXXXXXXXXXXXXXXXXXXXXXXpX-5' | "AS-M124*" |
| 3'-XpXXXXXXXXXXXXXXXXXXXXXXXXpX-5' | "AS-M125*" |
| 3'-XpFpXFXFXFXXXXXFXFXFXXXXFXpX-5' | "AS-M126*" |
| 3'-XpFpXFXFXFXXXXXFXFXFXXXXFXpX-5' | "AS-M127*" |
| 3'-XpFpXFXFXFXFXFXFXFXFXFFXXXpX-5' | "AS-M128*" |
| 3'-XpFpXFXFXFXFXFXFXFXFXFFFFFpF-5' | "AS-M129*" |
| 3'-XpFpXFXFXFXFXFXFXFXFXFXXXFXpX-5' | "AS-M130*" |
| 3'-XpFpXFXFXFXFXFXFXFXFXFXFXFpX-5' | "AS-M131*" |
| 3'-XpFpXFXFXFXFXFXFXFXFXFXXXXpX-5' | "AS-M132*" |

-continued

| | |
|---|---|
| 3'-XpFpXFXFXFXFXFXFXFXFXFXFXFXXXXpX-5' | "AS-M133*" |
| 3'-XpFpXFXFXFXFXFXFXFXFXFXFXFFFpF-5' | "AS-M134*" |
| 3'-XXXXXXXXXXXXXXXXXXXXXXXXXXXXXX-5' | "AS-M135*" |
| 3'-XXXXXXXXXXXXXXXXXXXXXXXXXXXXXX-5' | "AS-M136*" |
| 3'-XXXXXXXXXXXXXXXXXXXXXXXXXXXXXX-5' | "AS-M137*" |
| 3'-XXXFXFXFXXXXXFXFXFXFXXXXXXXX-5' | "AS-M138*" |
| 3'-XXXFXFXFFXXXXXXXFXXXXXXXX-5' | "AS-M139*" |
| 3'-XpXFXFXFXXXXXFXFFFXXXXXXpX-5' | "AS-M140*" |
| 3'-XpXXFXFXFFXXXFFXFXFFFXXXXXXpX-5' | "AS-M141*" |
| 3'-XpXXFXFXFXFXFXFXFFFXXXXXXpX-5' | "AS-M142*" |
| 3'-XpXXFXFXFFFFFFFXFXFFFXXXXXXpX-5' | "AS-M143*" |
| 3'-XpXXFXFXFXFXFXFXFXFpXpFpXXXXXXpX-5' | "AS-M144*" |
| 3'-XXXXXXXXXXXXXXFXXXXXXXXXXXX-5' | "AS-M145*" |
| 3'-XXXXXXXXXXXXXFXXXXXXXXXXXXX-5' | "AS-M146*" |
| 3'-XXXXXFXXXXXXXXXXXXXXXXXXXX-5' | "AS-M147*" |
| 3'-XXXXXXXXXFXXXXXXXXXXXXXXXX-5' | "AS-M148*" |
| 3'-XXXXXXXXXXFXXXXXXXXXXXXXXX-5' | "AS-M149*" |
| 3'-XXXXXXXXXXFXFXXXXXXXXXXXXX-5' | "AS-M150*" |
| 3'-XXXXXXXXXXXFXXFXXXXXXXXXXX-5' | "AS-M151*" |
| 3'-XXXXXXXXXXFXXXFXXXXXXXXXXX-5' | "AS-M152*" |
| 3'-XXXXXXXXFXXXXXXXXXXXXXXXXX-5' | "AS-M153*" |
| 3'-XXXXXXXXFXXXXXXXXXXXXXXXXX-5' | "AS-M154*" |
| 3'-XXXXXXFXXXXXXXXXXXXXXXXXXX-5' | "AS-M155*" |
| 3'-XpXXXXXXXXXXXXXXXXXXXXXXXXpX-5' | "AS-M156*" |
| 3'-XpXXXXXXXXXXXXXXXXXXXXXXXXXpX-5' | "AS-M157*" |
| 3'-XpXXFXFFFFXXXFXXFXFFXXXXXXpX-5' | "AS-M158*" |
| 3'-XpXXFXFFFFFFFFXXFXFXFFXXXXpX-5' | "AS-M159*" |
| 3'-XpXXFXXXFXXXXXFXFXXFFXXXXXXpX-5' | "AS-M160*" |
| 3'-XpXXFXXXFXFXFXFXXFFXXXXXXpX-5' | "AS-M161*" |
| 3'-XXXXXXXXFXFXFXXXXXXXXXXXXX-5' | "AS-M162*" |
| 3'-XXXXXXXXXXXXXXXXXXXXXXXXXXXX-5' | "AS-M163*" |
| 3'-XXXXXXXDXXXXXXXXXXXXXXXXXX-5' | "AS-M164*" |
| 3'-XXXXXXXXXXXXXXXXXXXXXXXXXXXX-5' | "AS-M211" |
| 3'-XXXXXXXXXXXXXXXXXXXXXXXXXXXX-5' | "AS-M212" |
| 3'-XXXXXXXXXXXXXXXXXXXXXXXXXXXX-5' | "AS-M215" |
| 3'-XXXXXXXXXXXXXXXXXXXXXXXXXXXX-5' | "AS-M216" |
| 3'-XXXXXXXXXXXXXXXXXXXXXXXXXXXX-5' | "AS-M217" |
| 3'-XXXXXXXXXXXXXXXXXXXXXXXXXXXX-5' | "AS-M218" |
| 3'-XXXXXXXXXXXXXXXXXXXXXXXXXXXX-5' | "AS-M219" |
| 3'-XXXXXXXXXXXXXXXXXXXXXXXXXXXX-5' | "AS-M220" |

-continued

| | |
|---|---|
| 3'-XXXXXXXXXXXXXXXXXXXXXXXXXXXX-5' | "AS-M221" |
| 3'-XXXXXXXXXXXXXXXXXXXXXXXXXXXX-5' | "AS-M222" |
| 3'-XXXXXXXXXXXXXXXXXXXXXXXXXXXX-5' | "AS-M223" |
| 3'-XXXXXXXXXXXXXXXXXXXXXXXXXXXX-5' | "AS-M224" |
| 3'-XXXXXXXXXXXXXXXXXXXXXXXXXXXX-5' | "AS-M225" |
| 3'-XXXXXXXXXXXXXXXXXXXXXXXXXXXX-5' | "AS-M226" |
| 3'-XXXXXXXXXXXXXXXXXXXXXXXXXXXX-5' | "AS-M230" |
| 3'-XXXXXXXXXXXXXXXXXXXXXXXXXXXX-5' | "AS-M231" |
| 3'-XXXXXXXXXXXXXXXXXXXXXXXXXXXX-5' | "AS-M232" |
| 3'-XXXXXXXXXXXXXXXXXXXXXXXXXXXX-5' | "AS-M233" |
| 3'-XXXXXXXXXXXXXXXXXXXXXXXXXXXX-5' | "AS-M234" |
| 3'-XXXXXXXXXXXXXXXXXXXXXXXXXXXX-5' | "AS-M235" |
| 3'-XXXXXXXXXXXXXXXXXXXXXXXXXXXX-5' | "AS-M236" |
| 3'-XXXXXXXXXXXXXXXXXXXXXXXXXXXX-5' | "AS-M237" |
| 3'-XXXXXXXXXXXXXXXXXXXXXXXXXXXX-5' | "AS-M238" |
| 3'-XXXXXXXXXXXXXXXXXXXXXXXXXXXX-5' | "AS-M239" |
| 3'-XXXXXXXXXXXXXXXXXXXXXXXXXXXX-5' | "AS-M240" |
| 3'-XXXXXXXXXXXXXXXXXXXXXXXXXXXX-5' | "AS-M241" |
| 3'-XXXXXXXXXXXXXXXXXXXXXXXXXXXX-5' | "AS-M242" |
| 3'-XpXXXXXXXXXXXXXXXXXXXXXXXXXpX-5' | "AS-M243" |
| 3'-XpXXXXXXXXXXXXXXXXXXXXXXXXXpX-5' | "AS-M244" |
| 3'-XpXXXXXXXXXXXXXXXXXXXXXXXXXpX-5' | "AS-M245" |
| 3'-XpXXXXXXXXXXXXXXXXXXXXXXXXXpX-5' | "AS-M246" |
| 3'-XpXXXXXXXXXXXXXXXXXXXXXXXXXpX-5' | "AS-M247" |
| 3'-XpXXXXXXXXXXXXXXXXXXXXXXXXXpX-5' | "AS-M248" |
| 3'-XpXXXXXXXXXXXXXXXXXXXXXXXXXpX-5' | "AS-M249" |
| 3'-XpXXXXXXXXXXXXXXXXXXXXXXXXXpX-5' | "AS-M250" |
| 3'-XpXXXXXXXXXXXXXXXXXXXXXXXXXpX-5' | "AS-M251" |
| 3'-XpXXXXXXXXXXXXXXXXXXXXXXXXXpX-5' | "AS-M252" |
| 3'-XpXXXXXXXXXXXXXXXXXXXXXXXXXpX-5' | "AS-M253" |
| 3'-XpXXXXXXXXXXXXXXXXXXXXXXXXXpX-5' | "AS-M254" |
| 3'-XpXXXXXXXXXXXXXXXXXXXXXXXXXpX-5' | "AS-M255" |
| 3'-XXXXXXXXXXXXXXXXXXXXXXXXXXXX-5' | "AS-M211*" |
| 3'-XXXXXXXXXXXXXXXXXXXXXXXXXXXX-5' | "AS-M212*" |
| 3'-XXXXXXXXXXXXXXXXXXXXXXXXXXXX-5' | "AS-M215*" |
| 3'-XXXXXXXXXXXXXXXXXXXXXXXXXXXX-5' | "AS-M216*" |
| 3'-XXXXXXXXXXXXXXXXXXXXXXXXXXXX-5' | "AS-M217*" |
| 3'-XXXXXXXXXXXXXXXXXXXXXXXXXXXX-5' | "AS-M218*" |
| 3'-XXXXXXXXXXXXXXXXXXXXXXXXXXXX-5' | "AS-M219*" |
| 3'-XXXXXXXXXXXXXXXXXXXXXXXXXXXX-5' | "AS-M220*" |
| 3'-XXXXXXXXXXXXXXXXXXXXXXXXXXXX-5' | "AS-M221*" |

-continued

```
3'-XXXXXXXXXXXXXXXXXXXXXXXXXXX-5'        "AS-M222*"
3'-XXXXXXXXXXXXXXXXXXXXXXXXXXX-5'        "AS-M223*"
3'-XXXXXXXXXXXXXXXXXXXXXXXXXXX-5'        "AS-M224*"
3'-XXXXXXXXXXXXXXXXXXXXXXXXXXX-5'        "AS-M225*"
3'-XXXXXXXXXXXXXXXXXXXXXXXXXXX-5'        "AS-M226*"
3'-XXXXXXXXXXXXXXXXXXXXXXXXXXX-5'        "AS-M230*"
3'-XXXXXXXXXXXXXXXXXXXXXXXXXXX-5'        "AS-M231*"
3'-XXXXXXXXXXXXXXXXXXXXXXXXXXX-5'        "AS-M232*"
3'-XXXXXXXXXXXXXXXXXXXXXXXXXXX-5'        "AS-M233*"
3'-XXXXXXXXXXXXXXXXXXXXXXXXXXX-5'        "AS-M234*"
3'-XXXXXXXXXXXXXXXXXXXXXXXXXXX-5'        "AS-M235*"
3'-XXXXXXXXXXXXXXXXXXXXXXXXXXX-5'        "AS-M236*"
3'-XXXXXXXXXXXXXXXXXXXXXXXXXXX-5'        "AS-M237*"
3'-XXXXXXXXXXXXXXXXXXXXXXXXXXX-5'        "AS-M238*"
3'-XXXXXXXXXXXXXXXXXXXXXXXXXXX-5'        "AS-M239*"
3'-XXXXXXXXXXXXXXXXXXXXXXXXXXX-5'        "AS-M240*"
3'-XXXXXXXXXXXXXXXXXXXXXXXXXXX-5'        "AS-M241*"
3'-XXXXXXXXXXXXXXXXXXXXXXXXXXX-5'        "AS-M242*"
3'-XpXXXXXXXXXXXXXXXXXXXXXXXXXpX-5'      "AS-M243*"
3'-XpXXXXXXXXXXXXXXXXXXXXXXXXXpX-5'      "AS-M244*"
3'-XpXXXXXXXXXXXXXXXXXXXXXXXXXpX-5'      "AS-M245*"
3'-XpXXXXXXXXXXXXXXXXXXXXXXXXXpX-5'      "AS-M246*"
3'-XpXXXXXXXXXXXXXXXXXXXXXXXXXpX-5'      "AS-M247*"
3'-XpXXXXXXXXXXXXXXXXXXXXXXXXXpX-5'      "AS-M248*"
3'-XpXXXXXXXXXXXXXXXXXXXXXXXXXpX-5'      "AS-M249*"
3'-XpXXXXXXXXXXXXXXXXXXXXXXXXXpX-5'      "AS-M250*"
3'-XpXXXXXXXXXXXXXXXXXXXXXXXXXpX-5'      "AS-M251*"
3'-XpXXXXXXXXXXXXXXXXXXXXXXXXXpX-5'      "AS-M252*"
3'-XpXXXXXXXXXXXXXXXXXXXXXXXXXpX-5'      "AS-M253*"
3'-XpXXXXXXXXXXXXXXXXXXXXXXXXXpX-5'      "AS-M254*"
3'-XpXXXXXXXXXXXXXXXXXXXXXXXXXpX-5'      "AS-M255*"
``` where "X"=RNA, "X"=2'-O-methyl RNA, "D"=DNA, "F"=2'-Fluoro NA and "p"=Phosphorothioate linkage.

In certain additional embodiments, the antisense strand of selected dsRNAs of the invention are extended, optionally at the 5' end, with an exemplary 5' extension of base "AS-M8", "AS-M17" and "AS-M48" modification patterns respectively represented as follows:

"AS-M8, extended"
(SEQ ID NO: 3493)
3'-XXXXXXXXXXXXXXXXXXXXXXXXXXXXUAGCUAUCGT-5'

"AS-M17, extended"
(SEQ ID NO: 3493)
3'-XXXXXXXXXXXXXXXXXXXXXXXXXXXXUAGCUAUCGT-5'

"AS-M48, extended"
(SEQ ID NO: 3493)
3'-XXXXXXXXXXXXXXXXXXXXXXXXXXXXUAGCUAUCGT-5' where "X"=RNA; "X"=2'-O-methyl RNA; "F"=2'-Fluoro NA and "A" in bold, italics indicates a 2'-Fluoro-adenine residue.

In certain embodiments, the sense strand of a DsiRNA of the invention is modified—specific exemplary forms of sense strand modifications are shown below, and it is contemplated that such modified sense strands can be substituted for the sense strand of any of the DsiRNAs shown above to generate a DsiRNA comprising a below-depicted sense strand that anneals with an above-depicted antisense strand. Exemplary sense strand modification patterns include:

```
5'-XXXXXXXXXXXXXXXXXXXXXXXXDD-3'        "SM1"
5'-XXXXXXXXXXXXXXXXXXXXXXXXDD-3'        "SM2"
5'-XXXXXXXXXXXXXXXXXXXXXXXXDD-3'        "SM3"
5'-XXXXXXXXXXXXXXXXXXXXXXXXDD-3'        "SM4"
5'-XXXXXXXXXXXXXXXXXXXXXXXXDD-3'        "SM5"
5'-XXXXXXXXXXXXXXXXXXXXXXXXDD-3'        "SM6"
5'-XXXXXXXXXXXXXXXXXXXXXXXXDD-3'        "SM7"
5'-XXXXXXXXXXXXXXXXXXXXXXXXDD-3'        "SM8"
5'-XXXXXXXXXXXXXXXXXXXXXXXXDD-3'        "SM9"
5'-XXXXXXXXXXXXXXXXXXXXXXXXDD-3'        "SM10"
5'-XXXXXXXXXXXXXXXXXXXXXXXXDD-3'        "SM11"
5'-XXXXXXXXXXXXXXXXXXXXXXXXDD-3'        "SM12"
5'-XXXXXXXXXXXXXXXXXXXXXXXXDD-3'        "SM13"
5'-XXXXXXXXXXXXXXXXXXXXXXXXDD-3'        "SM14"
5'-XXXXXXXXXXXXXXXXXXXXXXXXDD-3'        "SM15"
5'-XXXXXXXXXXXXXXXXXXXXXXXXDD-3'        "SM16"
5'-XXXXXXXXXXXXXXXXXXXXXXXXDD-3'        "SM17"
5'-XXXXXXXXXXXXXXXXXXXXXXXXDD-3'        "SM18"
5'-XXXXXXXXXXXXXXXXXXXXXXXXDD-3'        "SM19"
5'-XXXXXXXXXXXXXXXXXXXXXXXXDD-3'        "SM20"
5'-XXXXXXXXXXXXXXXXXXXXXXXXDD-3'        "SM21"
5'-XXXXXXXXXXXXXXXXXXXXXXXXDD-3'        "SM23"
5'-XXXXXXXXXXXXXXXXXXXXXXXXDD-3'        "SM24"
5'-XXXXXXXXXXXXXXXXXXXXXXXXDD-3'        "SM25"
5'-XXXXXXXXXXXXXXXXXXXXXXXXDD-3'        "SM30"
5'-XXXXXXXXXXXXXXXXXXXXXXXXDD-3'        "SM31"
5'-XXXXXXXXXXXXXXXXXXXXXXXXDD-3'        "SM32"
5'-XXXXXXXXXXXXXXXXXXXXXXXXDD-3'        "SM33"
5'-XXXXXXXXXXXXXXXXXXXXXXXXDD-3'        "SM34"
5'-XXXXXXXXXXXXXXXXXXXXXXXXDD-3'        "SM35"
```

| | | | |
|---|---|---|---|
| 5'-XXXXXXXXXXXXXXXXXXXXXXXXDD-3' | "SM36" | 5'-X pXpXXXXXXXXXXXXXXXXXXXXXDD-3' | "SM77" |
| 5'-XXXXXXXXXXXXXXXXXXXXXXXXDD-3' | "SM37" | 5'-X pXpXXXXXXXXXXXXXXXXXXXXXpDpD-3' | "SM78" |
| 5'-XXXXXXXXXXXXXXXXXXXXXXXXDD-3' | "SM38" | 5'-D pXpDXXXXXXXXXXXXXXXXXXXXDD-3' | "SM79" |
| 5'-XXXXXXXXXXXXXXXXXXXXXXXXDD-3' | "SM39" | 5'-X pXpDXXXXXXXXXDXXXXXXXXXXDD-3' | "SM80" |
| 5'-XXXXXXXXXXXXXXXXXXXXXXXXDD-3' | "SM40" | 5'-DXDXXXDXXXXXDXXXXXDXXXXDD-3' | "SM81" |
| 5'-XXXXXXXXXXXXXXXXXXXXXXXXDD-3' | "SM41" | 5'-DpXDXXXDXXXXXDXXXXXDXXXXpDpD-3' | "SM82" |
| 5'-XXXXXXXXXXXXXXXXXXXXXXXXDD-3' | "SM42" | 5' C3 spacer-XXXXXXXXXXXXXXXXXXXXXXXXDD-3' | "SM83" |
| 5'-XXXXXXXXXXXXXXXXXXXXXXXXDD-3' | "SM43" | 5' C3 spacer-XXDXXXXXXXXXDXXXXXXXXXXDD-3' | "SM84" |
| 5'-XXXXXXXXXXXXXXXXXXXXXXXXDD-3' | "SM44" | 5' C3 spacer-XXXXXXXXXXXXXXXXXXXXXXXXpDpD-3' | "SM85" |
| 5'-XXXXXXXXXXXXXXXXXXXXXXXXDD-3' | "SM45", "SM47" | 5'-XXXXXXXXXXXXXXXXXXXXXXXX pDpD-3' | "SM86" |
| 5'-XXXXXXXXXXXXXXXXXXXXXXXXDD-3' | "SM46" | 5'-XpXXXXXXXXXXXXXXXXXXXXXXXDD-3' | "SM87" |
| 5'-XXXXXXXXXXXXXXXXXXXXXXXXDD-3' | "SM48" | 5'-XpXXXXXXXXXXXXXXXXXXXXXXXpDpD-3' | "SM88" |
| 5'-XXXXXXXXXXXXXXXXXXXXXXXXDD-3' | "SM49" | 5'-DXXXXXXXXXXXXXXXXXXXXXXXXDD-3' | "SM89" |
| 5'-XXXXXXXXXXXXXXXXXXXXXXXXDD-3' | "SM50" | 5'-DpXXXXXXXXXXXXXXXXXXXXXXXpDpD-3' | "SM90" |
| 5'-XXXXXXXXXXXXXXXXXXXXXXXXDD-3' | "SM51" | 5'-DXDXXXXXXXXXXXXXXXXXXXXXDD-3' | "SM91" |
| 5'-XXXXXXXXXXXXXXXXXXXXXXXXDD-3' | "SM52" | 5'-DpXDXXXXXXXXXXXXXXXXXXXXXDD-3' | "SM92" |
| 5'-XXXXXXXXXXXXXXXXXXXXXXXXDD-3' | "SM53" | 5'-XXDXXXXXXXXXDXXXXXXXXXXDD-3' | "SM93" |
| 5'-XXXXXXXXXXXXXXXXXXXXXXXXDD-3' | "SM54" | 5'-XpXDXXXXXXXXXDXXXXXXXXXXDD-3' | "SM94" |
| 5'-XXXXXXXXXXXXXXXXXXXXXXXXDD-3' | "SM55" | 5'-DXDXXXXXXXXXDXXXXXDXXXXDD-3' | "SM95" |
| 5'-XXXXXXXXXXXXXXXXXXXXXXXXDD-3' | "SM56" | 5'-DpXDXXXXXXXXXDXXXXXDXXXXDD-3' | "SM96" |
| 5'-XXXXXXXXXXXXXXXXXXXXXXXXDD-3' | "SM57" | 5'-XpXpXXXXXXXXXXXXXXXXXXXXXDD-3' | "SM97" |
| 5'-XXXXXXXXXXXXXXXXXXXXXXXXDD-3' | "SM58" | 5'-XpXpXXXXXXXXXXXXXXXXXXXXXXpDpD-3' | "SM98" |
| 5'-XXXXXXXXXXXXXXXXXXXXXXXXDD-3' | "SM59" | 5'-DpXpDXXXXXXXXXXXXXXXXXXXXDD-3' | "SM99" |
| 5'-XXXXXXXXXXXXXXXXXXXXXXXXDD-3' | "SM60" | 5'-XpXpDXXXXXXXXXDXXXXXXXXXXDD-3' | "SM100" |
| 5'-XXXXXXXXXXXXXXXXXXXXXXXXDD-3' | "SM61" | 5'-DXDXXXXXXXXXDXDXXXDDXXDDD-3' | "SM101" |
| 5'-XXXXXXXXXXXXXXXXXXXXXXXXDD-3' | "SM62" | 5'-DpXDXXXDXXXXXDXXXXXDXXXXpDpD-3' | "SM102" |
| 5'-XXXXXXXXXXXXXXXXXXXXXXXXDD-3' | "SM63" | 5' C3 spacer-XXXXXXXXXXXXXXXXXXXXXXXXDD-3' | "SM103" |
| 5'-XXXXXXXXXXXXXXXXXXXXXXXXDD-3' | "SM64" | 5' C3 spacer-XXDXXXXXXXXXDXXXXXXXXXXDD-3' | "SM104" |
| 5'-XXXXXXXXXXXXXXXXXXXXXXXXDD-3' | "SM65" | 5' C3 spacer-XXXXXXXXXXXXXXXXXXXXXXXXpDpD-3' | "SM105" |
| 5'-XXXXXXXXXXXXXXXXXXXXXXXXXpDpD-3' | "SM66" | 5'-XXXXXXXXXXXXXXXXXXXXXXXXDD-3' | "SM106" |
| 5'-XpXXXXXXXXXXXXXXXXXXXXXXXDD-3' | "SM67" | 5'-XXXXXXXXXXXXXXXXXXXXXXXXDD-3' | "SM107" |
| 5'-XpXXXXXXXXXXXXXXXXXXXXXXXpDpD-3' | "SM68" | 5'-XXXXXXXXXXXXXXXXXXXXXXXXDD-3' | "SM108" |
| 5'-DXXXXXXXXXXXXXXXXXXXXXXXXDD-3' | "SM69" | 5'-XFXXXXXXXXXXXXXXXFXXXXXXDD-3' | "SM110" |
| 5'-DpXXXXXXXXXXXXXXXXXXXXXXXpDpD-3' | "SM70" | 5'-XXXFXFXXXXXXXXFXXXXXXXXDD-3' | "SM111" |
| 5'-DXDXXXXXXXXXXXXXXXXXXXXXDD-3' | "SM71" | 5'-XFXFXFXFXXXXFXFXFXFXXXXXDD-3' | "SM112" |
| 5'-DpXDXXXXXXXXXXXXXXXXXXXXXDD-3' | "SM72" | 5'-XpFXFXFXFXXXXFXFXFXFXXXXXpDpD-3' | "SM113" |
| 5'-XXDXXXXXXXXXDXXXXXXXXXXDD-3' | "SM73" | 5'-XFXXXXXXXXXXXXXXXXXXXXXXDD-3' | "SM114" |
| 5'-XpXDXXXXXXXXXDXXXXXXXXXXDD-3' | "SM74" | 5'-XXXXFFXFXXXFXFXXXXXXXXDD-3' | "SM115" |
| 5'-DXDXXXXXXXXXDXXXXXDXXXXDD-3' | "SM75" | | |
| 5'-DpXDXXXXXXXXXDXXXXXDXXXXDD-3' | "SM76" | | |

-continued

| | |
|---|---|
| 5'-XFXFXXXXXXXXXXXXFXXXXXXDD-3' | "SM116" |
| 5'-XFXFFFXFXXXFXFXFFFXXXXXDD-3' | "SM117" |
| 5'-XFXFXFXFXXXFXFXFXFXXXXXDD-3' | "SM118" |
| 5'-XpFXFXFXFXXXFXFXFXFXXXXXpDpD-3' | "SM119" |
| 5'-XXXXXXXXXXXXXXXXXXXXXXXDD-3' | "SM250" |
| 5'-XXXXXXXXXXXXXXXXXXXXXXXDD-3' | "SM251" |
| 5'-XXXXXXXXXXXXXXXXXXXXXXXDD-3' | "SM252" |
| 5'-XXXXXXXXXXXXXXXXXXXXXXXXX-3' | |
| 5'-XXXXXXXXXXXXXXXXXXXXXXXXX-3' | |
| 5'-XXXXXXXXXXXXXXXXXXXXXXXXX-3' | |
| 5'-XXXXXXXXXXXXXXXXXXXXXXXXX-3' | |
| 5'-XXXXXXXXXXXXXXXXXXXXXXXXX-3' | |
| 5'-XXXXXXXXXXXXXXXXXXXXXXXXX-3' | |
| 5'-XXXXXXXXXXXXXXXXXXXXXXXXX-3' | |
| 5'-XXXXXXXXXXXXXXXXXXXXXXXXX-3' | |
| 5'-XXXXXXXXXXXXXXXXXXXXXXXXX-3' | |
| 5'-XXXXXXXXXXXXXXXXXXXXXXXXX-3' | |
| 5'-XXXXXXXXXXXXXXXXXXXXXXXXX-3' | |
| 5'-XXXXXXXXXXXXXXXXXXXXXXXXX-3' | |
| 5'-XXXXXXXXXXXXXXXXXXXXXXXXX-3' | |
| 5'-XXXXXXXXXXXXXXXXXXXXXXXXX-3' | |
| 5'-XXXXXXXXXXXXXXXXXXXXXXXXX-3' | |
| 5'-XXXXXXXXXXXXXXXXXXXXXXXXX-3' | |
| 5'-XXXXXXXXXXXXXXXXXXXXXXXXX-3' | |
| 5'-XXXXXXXXXXXXXXXXXXXXXXXXX-3' | |
| 5'-XXXXXXXXXXXXXXXXXXXXXXXXX-3' | |
| 5'-XXXXXXXXXXXXXXXXXXXXXXXXX-3' | |
| 5'-XXXXXXXXXXXXXXXXXXXXXXXXX-3' | |
| 5'-XXXXXXXXXXXXXXXXXXXXXXXXX-3' | |
| 5'-XXXXXXXXXXXXXXXXXXXXXXXXX-3' | |
| 5'-XXXXXXXXXXXXXXXXXXXXXXXXX-3' | |
| 5'-XXXXXXXXXXXXXXXXXXXXXXXXX-3' | |
| 5'-XXXXXXXXXXXXXXXXXXXXXXXXX-3' | |
| 5'-XXXXXXXXXXXXXXXXXXXXXXXXX-3' | |
| 5'-XXXXXXXXXXXXXXXXXXXXXXXXX-3' | |
| 5'-XXXXXXXXXXXXXXXXXXXXXXXXX-3' | |
| 5'-XXXXXXXXXXXXXXXXXXXXXXXXX-3' | |
| 5'-XXXXXXXXXXXXXXXXXXXXXXXXX-3' | |

-continued

| | |
|---|---|
| 5'-XXXXXXXXXXXXXXXXXXXXXXXXXX-3' | |
| 5'-XXXXXXXXXXXXXXXXXXXXXXXXXX-3' | |
| 5'-XXXXXXXXXXXXXXXXXXXXXXXXXX-3' | |
| 5'-XXXXXXXXXXXXXXXXXXXXXXXXXX-3' | |
| 5'-XXXXXXXXXXXXXXXXXXXXXXXXXX-3' | |
| 5'-XXXXXXXXXXXXXXXXXXXXXXXXXX-3' | |
| 5'-XXXXXXXXXXXXXXXXXXXXXXXXXX-3' | |
| 5'-XXXXXXXXXXXXXXXXXXXXXXXXXX-3' | |
| 5'-XXXXXXXXXXXXXXXXXXXXXXXXXX-3' | |
| 5'-XXXXXXXXXXXXXXXXXXXXXXXXXX-3' | |
| 5'-XXXXXXXXXXXXXXXXXXXXXXXXXX-3' | |
| 5'-XXXXXXXXXXXXXXXXXXXXXXXXXX-3' | |
| 5'-XXXXXXXXXXXXXXXXXXXXXXXXXX-3' | "SM22" |
| 5'-XXXXXXXXXXXXXXXXXXXXXXXXXX-3 | |
| 5'-XXXXXXXXXXXXXXXXXXXXXXXXXX-3' | |
| 5'-XXXXXXXXXXXXXXXXXXXXXXXXXX-3' | |
| 5'-XpXXXXXXXXXXXXXXXXXXXXXXXDpD-3' | "SM120" |
| 5'-FpXFXFXFXFXFXFXFXFXFXFXXDpD-3' | "SM121" |
| 5'-XpXXXXXXXXXXXXXXXXXXXXXXXDpD-3' | "SM122" |
| 5'-XpXXXXXXXXXXXXXXXXXXXXXXXDpD-3' | "SM123" |
| 5'-FpXFXXXFXXXXXXXXXXXXXXXpDpD-3' | "SM124" |
| 5'-FpXFXXXFXXXXXFXFXXXXXXXXpDpD-3' | "SM125" |
| 5'-FpXFXXXFXFFFXFXFXXXXXXXXpDpD-3' | "SM126" |
| 5'-FpXFXXXFXFFFXFXFXXXFXXXXpDpD-3' | "SM127" |
| 5'-FpXFXXXFXFFFXFXFXXXFFXXpDpD-3' | "SM128" |
| 5'-FpXFXXXFXFFFXFXFXXXFFFFpDpD-3' | "SM129" |
| 5'-FpXFXFXFXFXFXFXFXFXFXFpDpD-3' | "SM130" |
| 5'-XpXXXXXXXXXXXXXXXXXXXXXXXpX-3' | |
| 5'-FpXFXFXFXFXFXFXFXFXFXFXXXpX-3' | |
| 5'-XpXXXXXXXXXXXXXXXXXXXXXXXpX-3' | |
| 5'-XpXXXXXXXXXXXXXXXXXXXXXXXpX-3' | |
| 5'-FpXFXXXFXXXXXXXXXXXXXXXpXpX-3' | |
| 5'-FpXFXXXFXXXXXFXFXXXXXXXXpXpX-3' | |
| 5'-FpXFXXXFXFFFXFXFXXXXXXXXpXpX-3' | |
| 5'-FpXFXXXFXFFFXFXFXXXFXXXXpXpX-3' | |
| 5'-FpXFXXXFXFFFXFXFXXXFFXXpXpX-3' | |
| 5'-FpXFXXXFXFFFXFXFXXXFFFFpXpX-3' | |
| 5'-FpXFXFXFXFXFXFXFXFXFXFpXpX-3' | |
| 5'-XpXXXXXXXXXXXXXXXXXXXXXXXpDpD-3' | "SM133" |
| 5'-XpXXXXXXXXXXXXXXXXXXXXXXXpDpD-3' | "SM134" |

```
5'-XpXXXXXXXXXXXXXXXXXXXXXpDpD-3'                "SM135"
5'-XpXXXXXXXXXXXXXXXXXXXXXpDpD-3'                "SM136"
5'-XpXXXXXXXXXXXXXXXXXXXXXpDpD-3'                "SM137"
5'-XpXXXXXXXXXXXXXXXXXXXXXpDpD-3'                "SM138"
5'-XpXXXXXXXXXXXXXXXXXXXXXXpXpX-3'
5'-XpXXXXXXXXXXXXXXXXXXXXXXpXpX-3'
5'-XpXXXXXXXXXXXXXXXXXXXXXXpXpX-3'
5'-XpXXXXXXXXXXXXXXXXXXXXXXpXpX-3'
5'-XpXXXXXXXXXXXXXXXXXXXXXXpXpX-3'
5'-XpXXXXXXXXXXXXXXXXXXXXXXpXpX-3'
5'-XpXXXXXXXXXXXXXXXXXXXXXDpD-3'                 "SM140"
5'-XpXXXXXXXXXXXXXXXXXXXXXDpD-3'                 "SM141"
5'-XpXXXXXXXXXXXXXXXXXXXXXDpD-3'                 "SM142"
5'-FpXFXFXFXFXFXFXFXFXXXFDpD-3'                  "SM143"
5'-FpXFXFXFXFXFXFXFXFFFFFDpD-3'                  "SM144"
5'-FpXFXFXFXFXFXFXFXFXXXXDpD-3'                  "SM145"
5'-FpXFXFXFXFXFXFXFXFXFXFDpD-3'                  "SM146"
5'-FXFXXXFXFFFXFXFXXXXXXXXDD-3'                  "SM147"
5'-FXFXXXFXFFFXFXFXXXFFXXXDD-3'                  "SM148"
5'-FXFXXXFXFFFXFXFXXXFFXXFDD-3'                  "SM149"
5'-FXFXXXFXFFFXFXFXXXFFFFFDD-3'                  "SM150"
5'-FpXFXFXFXFFFXFXFXFFXXFDpD-3'                  "SM151"
5'-FpXFXFXFXFFFXXXFXFXFXXXXDpD-3'                "SM152"
5'-FpXFXFXXXFFFFFXXXFXFXXXFXXDpD-3'              "SM153"
5'-ab-XXFXXFFFXXFFXXXFFFFXpXXXDD-3'              "SM154"
(ab = abasic for F7 stabilization at 5' end)
5'-XpXXXXXXXXXXXXXXXXXXXXXXpX-3'                 "SM155"
5'-XpXXXXXXXXXXXXXXXXXXXXXXpX-3'                 "SM156"
5'-FpXFXXXFFFFFFFXXXFXXFXXFXpX-3'                "SM157"
5'-XpXFXFXXFFFFXFXFXFXFXXXXpX-3'                 "SM158"
5'-FpXFXXXFXFFXFXXXFXXXFXXXXpX-3'                "SM159"
5'-FpXFXFXFXFFFXFXFXFXFXXXXXX-3'                 "SM160"
5'-XpXXXXXXXXXXXXXXXXXXXXXXpX-3'
5'-XpXXXXXXXXXXXXXXXXXXXXXXpX-3'
5'-XpXXXXXXXXXXXXXXXXXXXXXXpX-3'
5'-FpXFXFXFXFXFXFXFXFXXXFXpX-3'
5'-FpXFXFXFXFXFXFXFXFFFFFXpX-3'
5'-FpXFXFXFXFXFXFXFXFXXXXXpX-3'
5'-FpXFXFXFXFXFXFXFXFXFXFXpX-3'
5'-FXFXXXFXFFFXFXFXXXXXXXXXX-3'
5'-FXFXXXFXFFFXFXFXXXFFXXXXX-3'
5'-FXFXXXFXFFFXFXFXXXFFXXFXX-3'
5'-FXFXXXFXFFFXFXFXXXFFFFFXX-3'
5'-FpXFXFXFXFFFXFXFXFXFXXFXpX-3'
5'-FpXFXFXFXFFFXXXFXFXFXXXXpX-3'
5'-FpXFXFXXXFFFFFXXXFXFXXXXXpX-3'
5'-ab-XXFXXFFFXXFFXXXFFFFXpXXXXX-3'
(ab = abasic for F7 stabilization at 5' end)
5'-XpXXXXXXXXXXXXXXXXXXXXXXpX-3'
5'-XpXXXXXXXXXXXXXXXXXXXXXXpX-3'
5'-FpXFXXXFFFFFFFXXXFXXFXXFXpX-3'
5'-XpXFXFXXFFFFXFXFXFXFXXXXpX-3'
5'-FpXFXXXFXFFXFXXXFXXXFXXXXpX-3'
5'-FpXFXFXFXFFFXFXFXFXFXXXXXX-3'
5'-XXXXXXXXXXXXXXXXXXXXXXXDD-3'                  "SM253"
5'-XXXXXXXXXXXXXXXXXXXXXXXDD-3'                  "SM255"
5'-XXXXXXXXXXXXXXXXXXXXXXXDD-3'                  "SM256"
5'-XXXXXXXXXXXXXXXXXXXXXXXDD-3'                  "SM257"
5'-XXXXXXXXXXXXXXXXXXXXXXXDD-3'                  "SM258"
5'-XXXXXXXXXXXXXXXXXXXXXXXDD-3'                  "SM259"
5'-XXXXXXXXXXXXXXXXXXXXXXXDD-3'                  "SM260"
5'-XXXXXXXXXXXXXXXXXXXXXXXDD-3'                  "SM261"
5'-XXXXXXXXXXXXXXXXXXXXXXXDD-3'                  "SM262"
5'-XXXXXXXXXXXXXXXXXXXXXXXDD-3'                  "SM263"
5'-XXXXXXXXXXXXXXXXXXXXXXXDD-3'                  "SM264"
5'-XXXXXXXXXXXXXXXXXXXXXXXDD-3'                  "SM265"
5'-XXXXXXXXXXXXXXXXXXXXXXXDD-3'                  "SM266"
5'-XXXXXXXXXXXXXXXXXXXXXXXDD-3'                  "SM267"
5'-XXXXXXXXXXXXXXXXXXXXXXXDD-3'                  "SM268"
5'-XXXXXXXXXXXXXXXXXXXXXXXDD-3'                  "SM269"
5'-XXXXXXXXXXXXXXXXXXXXXXXDD-3'                  "SM270"
5'-XXXXXXXXXXXXXXXXXXXXXXXDD-3'                  "SM271"
5'-XXXXXXXXXXXXXXXXXXXXXXXDD-3'                  "SM275"
5'-XXXXXXXXXXXXXXXXXXXXXXXDD-3'                  "SM276"
5'-XXXXXXXXXXXXXXXXXXXXXXXDD-3'                  "SM277"
5'-XXXXXXXXXXXXXXXXXXXXXXXDD-3'                  "SM278"
5'-XXXXXXXXXXXXXXXXXXXXXXXDD-3'                  "SM279"
5'-XXXXXXXXXXXXXXXXXXXXXXXDD-3'                  "SM280"
5'-XXXXXXXXXXXXXXXXXXXXXXXDD-3'                  "SM281"
5'-XXXXXXXXXXXXXXXXXXXXXXXDD-3'                  "SM282"
5'-XXXXXXXXXXXXXXXXXXXXXXXDD-3'                  "SM283"
```

```
5'-XXXXXXXXXXXXXXXXXXXXXXXXXDD-3'          "SM284"
5'-XXXXXXXXXXXXXXXXXXXXXXXXXDD-3'          "SM285"
5'-XXXXXXXXXXXXXXXXXXXXXXXXXDD-3'          "SM286"
5'-XXXXXXXXXXXXXXXXXXXXXXXXXDD-3'          "SM287"
5'-XXXXXXXXXXXXXXXXXXXXXXXXXDD-3'          "SM288"
5'-XXXXXXXXXXXXXXXXXXXXXXXXXDD-3'          "SM289"
5'-XXXXXXXXXXXXXXXXXXXXXXXXXXX-3'
5'-XXXXXXXXXXXXXXXXXXXXXXXXXXX-3'
5'-XXXXXXXXXXXXXXXXXXXXXXXXXXX-3'
5'-XXXXXXXXXXXXXXXXXXXXXXXXXXX-3'
5'-XXXXXXXXXXXXXXXXXXXXXXXXXXX-3'
5'-XXXXXXXXXXXXXXXXXXXXXXXXXXX-3'
5'-XXXXXXXXXXXXXXXXXXXXXXXXXXX-3'
5'-XXXXXXXXXXXXXXXXXXXXXXXXXXX-3'
5'-XXXXXXXXXXXXXXXXXXXXXXXXXXX-3'
5'-XXXXXXXXXXXXXXXXXXXXXXXXXXX-3'
5'-XXXXXXXXXXXXXXXXXXXXXXXXXXX-3'
5'-XXXXXXXXXXXXXXXXXXXXXXXXXXX-3'
5'-XXXXXXXXXXXXXXXXXXXXXXXXXXX-3'
5'-XXXXXXXXXXXXXXXXXXXXXXXXXXX-3'
5'-XXXXXXXXXXXXXXXXXXXXXXXXXXX-3'
5'-XXXXXXXXXXXXXXXXXXXXXXXXXXX-3'
5'-XXXXXXXXXXXXXXXXXXXXXXXXXXX-3'
5'-XXXXXXXXXXXXXXXXXXXXXXXXXXX-3'
5'-XXXXXXXXXXXXXXXXXXXXXXXXXXX-3'
5'-XXXXXXXXXXXXXXXXXXXXXXXXXXX-3'
5'-XXXXXXXXXXXXXXXXXXXXXXXXXXX-3'
5'-XXXXXXXXXXXXXXXXXXXXXXXXXXX-3'
5'-XXXXXXXXXXXXXXXXXXXXXXXXXXX-3'
5'-XXXXXXXXXXXXXXXXXXXXXXXXXXX-3'
5'-XXXXXXXXXXXXXXXXXXXXXXXXXXX-3'
5'-XXXXXXXXXXXXXXXXXXXXXXXXXXX-3'
5'-XXXXXXXXXXXXXXXXXXXXXXXXXXX-3'
5'-XXXXXXXXXXXXXXXXXXXXXXXXXXX-3'
5'-XXXXXXXXXXXXXXXXXXXXXXXXXXX-3'
5'-XXXXXXXXXXXXXXXXXXXXXXXXXXX-3'
5'-XXXXXXXXXXXXXXXXXXXXXXXXXXX-3'
5'-XXXXXXXXXXXXXXXXXXXXXXXXXXX-3'
5'-XXXXXXXXXXXXXXXXXXXXXXXXXXX-3'
5'-XXXXXXXXXXXXXXXXXXXXXXXXXDD-3'          "SM300"
5'-XpXXXXXXXXXXXXXXXXXXXXXXXXXDpD-3'       "SM301"
5'-XpXXXXXXXXXXXXXXXXXXXXXXXXXDpD-3'       "SM302"
5'-XpXXXXXXXXXXXXXXXXXXXXXXXXXDpD-3'       "SM303"
5'-XpXXXXXXXXXXXXXXXXXXXXXXXXXDpD-3'       "SM304"
5'-XpXXXXXXXXXXXXXXXXXXXXXXXXXDpD-3'       "SM305"
5'-XpXXXXXXXXXXXXXXXXXXXXXXXXXDpD-3'       "SM306"
5'-XpXXXXXXXXXXXXXXXXXXXXXXXXXDpD-3'       "SM307"
5'-XpXXXXXXXXXXXXXXXXXXXXXXXXXDpD-3'       "SM308"
5'-XpXXXXXXXXXXXXXXXXXXXXXXXXXDpD-3'       "SM309"
5'-XpXXXXXXXXXXXXXXXXXXXXXXXXXDpD-3'       "SM310"
5'-XXXXXXXXXXXXXXXXXXXXXXXXXXX-3'
5'-XpXXXXXXXXXXXXXXXXXXXXXXXXXpX-3'
5'-XpXXXXXXXXXXXXXXXXXXXXXXXXXpX-3'
5'-XpXXXXXXXXXXXXXXXXXXXXXXXXXpX-3'
5'-XpXXXXXXXXXXXXXXXXXXXXXXXXXpX-3'
5'-XpXXXXXXXXXXXXXXXXXXXXXXXXXpX-3'
5'-XpXXXXXXXXXXXXXXXXXXXXXXXXXpX-3'
5'-XpXXXXXXXXXXXXXXXXXXXXXXXXXpX-3'
5'-XpXXXXXXXXXXXXXXXXXXXXXXXXXpX-3'
5'-XpXXXXXXXXXXXXXXXXXXXXXXXXXpX-3'
5'-XpXXXXXXXXXXXXXXXXXXXXXXXXXpX-3'
``` where "X"=RNA, "$\underline{X}$"=2'-O-methyl RNA, "D"=DNA, "F"=2'-Fluoro NA and "p"=Phosphorothioate linkage.

The above modification patterns can also be incorporated into, e.g., the extended DsiRNA structures and mismatch and/or frayed DsiRNA structures described below.

In another embodiment, the DsiRNA comprises strands having equal lengths possessing 1-3 mismatched residues that serve to orient Dicer cleavage (specifically, one or more of positions 1, 2 or 3 on the first strand of the DsiRNA, when numbering from the 3'-terminal residue, are mismatched with corresponding residues of the 5'-terminal region on the second strand when first and second strands are annealed to one another). An exemplary 27mer DsiRNA agent with two terminal mismatched residues is shown:

```
5'-XXXXXXXXXXXXXXXXXXXXXXXXXX$X^M$ $M$-3'
3'-XXXXXXXXXXXXXXXXXXXXXXXXXX$X_M$ $M$-5'
``` wherein "X"=RNA, "M"=Nucleic acid residues (RNA, DNA or non-natural or modified nucleic acids) that do not base pair (hydrogen bond) with corresponding "M" residues of otherwise complementary strand when strands are annealed. Any of the residues of such agents can optionally be 2'-O-methyl RNA monomers—alternating positioning of 2'-O-methyl RNA monomers that commences from the 3'-terminal residue of the bottom (second) strand, as shown for above asymmetric agents, can also be used in the above "blunt/fray" DsiRNA agent. In one embodiment, the top strand is the sense strand, and the bottom strand is the antisense strand. Alternatively, the bottom strand is the sense strand and the top strand is the antisense strand.

In certain additional embodiments, the present invention provides compositions for RNA interference (RNAi) that possess one or more base paired deoxyribonucleotides within a region of a double stranded ribonucleic acid (dsRNA) that is positioned 3' of a projected sense strand Dicer cleavage site and correspondingly 5' of a projected antisense strand Dicer cleavage site. The compositions of the invention comprise a dsRNA which is a precursor molecule, i.e., the dsRNA of the present invention is processed in vivo to produce an active small interfering nucleic acid (siRNA). The dsRNA is processed by Dicer to an active siRNA which is incorporated into RISC.

In certain embodiments, the DsiRNA agents of the invention can have the following exemplary structures (noting that any of the following exemplary structures can be combined, e.g., with the bottom strand modification patterns of the above-described structures—in one specific example, the bottom strand modification pattern shown in any of the above structures is applied to the 27 most 3' residues of the bottom strand of any of the following structures; in another specific example, the bottom strand modification pattern shown in any of the above structures upon the 23 most 3' residues of the bottom strand is applied to the 23 most 3' residues of the bottom strand of any of the following structures):

In one such embodiment, the DsiRNA comprises the following (an exemplary "right-extended", "DNA extended" DsiRNA):

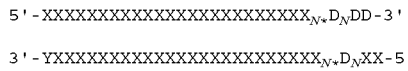

wherein "X"=RNA, "Y" is an optional overhang domain comprised of 0-10 RNA monomers that are optionally 2'-O-methyl RNA monomers—in certain embodiments, "Y" is an overhang domain comprised of 1-4 RNA monomers that are optionally 2'-O-methyl RNA monomers, "D"=DNA, and "N"=1 to 50 or more, but is optionally 1-8 or 1-10. "N*"=0 to 15 or more, but is optionally 0, 1, 2, 3, 4, 5 or 6. In one embodiment, the top strand is the sense strand, and the bottom strand is the antisense strand. Alternatively, the bottom strand is the sense strand and the top strand is the antisense strand.

In a related embodiment, the DsiRNA comprises:

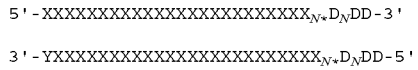

wherein "X"=RNA, "Y" is an optional overhang domain comprised of 0-10 RNA monomers that are optionally 2'-O-methyl RNA monomers—in certain embodiments, "Y" is an overhang domain comprised of 1-4 RNA monomers that are optionally 2'-O-methyl RNA monomers, "D"=DNA, and "N"=1 to 50 or more, but is optionally 1-8 or 1-10. "N*"=0 to 15 or more, but is optionally 0, 1, 2, 3, 4, 5 or 6. In one embodiment, the top strand is the sense strand, and the bottom strand is the antisense strand. Alternatively, the bottom strand is the sense strand and the top strand is the antisense strand.

In an additional embodiment, the DsiRNA comprises:

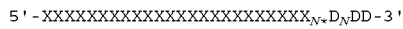

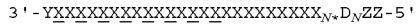

wherein "X"=RNA, "X"=2'-O-methyl RNA, "Y" is an optional overhang domain comprised of 0-10 RNA monomers that are optionally 2'-O-methyl RNA monomers—in certain embodiments, "Y" is an overhang domain comprised of 1-4 RNA monomers that are optionally 2'-O-methyl RNA monomers, "D"=DNA, "Z"=DNA or RNA, and "N"=1 to 50 or more, but is optionally 1-8 or 1-10. "N*"=0 to 15 or more, but is optionally 0, 1, 2, 3, 4, 5 or 6. In one embodiment, the top strand is the sense strand, and the bottom strand is the antisense strand. Alternatively, the bottom strand is the sense strand and the top strand is the antisense strand, with 2'-O-methyl RNA monomers located at alternating residues along the top strand, rather than the bottom strand presently depicted in the above schematic.

In another such embodiment, the DsiRNA comprises:

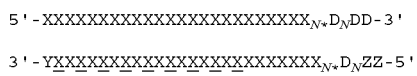

wherein "X"=RNA, "X"=2'-O-methyl RNA, "Y" is an optional overhang domain comprised of 0-10 RNA monomers that are optionally 2'-O-methyl RNA monomers—in certain embodiments, "Y" is an overhang domain comprised of 1-4 RNA monomers that are optionally 2'-O-methyl RNA monomers, "D"=DNA, "Z"=DNA or RNA, and "N"=1 to 50 or more, but is optionally 1-8 or 1-10. "N*"=0 to 15 or more, but is optionally 0, 1, 2, 3, 4, 5 or 6. In one embodiment, the top strand is the sense strand, and the bottom strand is the antisense strand. Alternatively, the bottom strand is the sense strand and the top strand is the antisense strand, with 2'-O-methyl RNA monomers located at alternating residues along the top strand, rather than the bottom strand presently depicted in the above schematic.

In another such embodiment, the DsiRNA comprises:

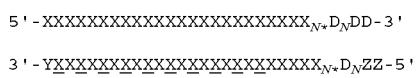

wherein "X"=RNA, "X"=2'-O-methyl RNA, "Y" is an optional overhang domain comprised of 0-10 RNA monomers that are optionally 2'-O-methyl RNA monomers—in certain embodiments, "Y" is an overhang domain comprised of 1-4 RNA monomers that are optionally 2'-O-methyl RNA monomers, "D"=DNA, "Z"=DNA or RNA, and "N"=1 to 50 or more, but is optionally 1-8 or 1-10. "N*"=0 to 15 or more, but is optionally 0, 1, 2, 3, 4, 5 or 6. In one embodiment, the top strand is the sense strand, and the bottom strand is the antisense strand. Alternatively, the bottom strand is the sense strand and the top strand is the antisense strand, with 2'-O-methyl RNA monomers located at alternating residues along the top strand, rather than the bottom strand presently depicted in the above schematic.

In another embodiment, the DsiRNA comprises:

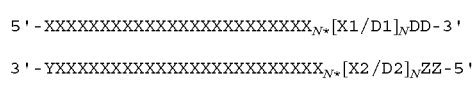

wherein "X"=RNA, "Y" is an optional overhang domain comprised of 0-10 RNA monomers that are optionally 2'-O-methyl RNA monomers—in certain embodiments, "Y" is an overhang domain comprised of 1-4 RNA monomers that are optionally 2'-O-methyl RNA monomers, "D"=DNA, "Z"=DNA or RNA, and "N"=1 to 50 or more, but is optionally 1-8 or 1-10, where at least one $D1_N$ is present in the top strand and is base paired with a corresponding $D2_N$ in the bottom strand. Optionally, $D1_N$ and $D1_{N+1}$ are base paired with corresponding $D2_N$ and $D2_{N+1}$; $D1_N$, $D1_{N+1}$ and $D1_{N+2}$ are base paired with corresponding $D2_N$, $D1_{N+1}$ and $D1_{N+2}$, etc. "N*"=0 to 15 or more, but is optionally 0, 1, 2, 3, 4, 5 or 6. In one embodiment, the top strand is the sense strand, and the bottom strand is the antisense strand. Alternatively, the bottom strand is the sense strand and the top strand is the antisense strand, with 2'-O-methyl RNA monomers located at alternating residues along the top strand, rather than the bottom strand presently depicted in the above schematic.

In the structures depicted herein, the 5' end of either the sense strand or antisense strand can optionally comprise a phosphate group.

In another embodiment, a DNA:DNA-extended DsiRNA comprises strands having equal lengths possessing 1-3 mismatched residues that serve to orient Dicer cleavage (specifically, one or more of positions 1, 2 or 3 on the first strand of the DsiRNA, when numbering from the 3'-terminal residue, are mismatched with corresponding residues of the 5'-terminal region on the second strand when first and second strands are annealed to one another). An exemplary DNA:DNA-extended DsiRNA agent with two terminal mismatched residues is shown:

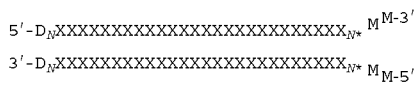

wherein "X"=RNA, "M"=Nucleic acid residues (RNA, DNA or non-natural or modified nucleic acids) that do not base pair (hydrogen bond) with corresponding "M" residues of otherwise complementary strand when strands are annealed, "D"=DNA and "N"=1 to 50 or more, but is optionally 1-15 or, optionally, 1-8. "N*"=0 to 15 or more, but is optionally 0, 1, 2, 3, 4, 5 or 6. Any of the residues of such agents can optionally be 2'-O-methyl RNA monomers—alternating positioning of 2'-O-methyl RNA monomers that commences from the 3'-terminal residue of the bottom (second) strand, as shown for above asymmetric agents, can also be used in the above "blunt/fray" DsiRNA agent. In one embodiment, the top strand (first strand) is the sense strand, and the bottom strand (second strand) is the antisense strand. Alternatively, the bottom strand is the sense strand and the top strand is the antisense strand. Modification and DNA:DNA extension patterns paralleling those shown above for asymmetric/overhang agents can also be incorporated into such "blunt/frayed" agents.

In one embodiment, a length-extended DsiRNA agent is provided that comprises deoxyribonucleotides positioned at sites modeled to function via specific direction of Dicer cleavage, yet which does not require the presence of a base-paired deoxyribonucleotide in the dsRNA structure. An exemplary structure for such a molecule is shown:

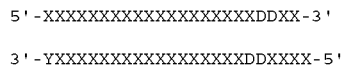

wherein "X"=RNA, "Y" is an optional overhang domain comprised of 0-10 RNA monomers that are optionally 2'-O-methyl RNA monomers—in certain embodiments, "Y" is an overhang domain comprised of 1-4 RNA monomers that are optionally 2'-O-methyl RNA monomers, and "D"=DNA. In one embodiment, the top strand is the sense strand, and the bottom strand is the antisense strand. Alternatively, the bottom strand is the sense strand and the top strand is the antisense strand. The above structure is modeled to force Dicer to cleave a minimum of a 21mer duplex as its primary post-processing form. In embodiments where the bottom strand of the above structure is the antisense strand, the positioning of two deoxyribonucleotide residues at the ultimate and penultimate residues of the 5' end of the antisense strand will help reduce off-target effects (as prior studies have shown a 2'-O-methyl modification of at least the penultimate position from the 5' terminus of the antisense strand to reduce off-target effects; see, e.g., US 2007/0223427).

In one embodiment, the DsiRNA comprises the following (an exemplary "left-extended", "DNA extended" DsiRNA):

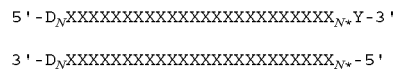

wherein "X"=RNA, "Y" is an optional overhang domain comprised of 0-10 RNA monomers that are optionally 2'-O-methyl RNA monomers—in certain embodiments, "Y" is an overhang domain comprised of 1-4 RNA monomers that are optionally 2'-O-methyl RNA monomers, "D"=DNA, and "N"=1 to 50 or more, but is optionally 1-8 or 1-10. "N*"=0 to 15 or more, but is optionally 0, 1, 2, 3, 4, 5 or 6. In one embodiment, the top strand is the sense strand, and the bottom strand is the antisense strand. Alternatively, the bottom strand is the sense strand and the top strand is the antisense strand.

In a related embodiment, the DsiRNA comprises:

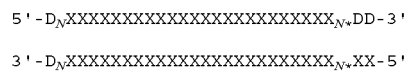

wherein "X"=RNA, optionally a 2'-O-methyl RNA monomers "D"=DNA, "N"=1 to 50 or more, but is optionally 1-8 or 1-10. "N*"=0 to 15 or more, but is optionally 0, 1, 2, 3, 4, 5 or 6. In one embodiment, the top strand is the sense strand, and the bottom strand is the antisense strand. Alternatively, the bottom strand is the sense strand and the top strand is the antisense strand.

In an additional embodiment, the DsiRNA comprises:

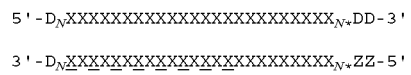

wherein "X"=RNA, optionally a 2'-O-methyl RNA monomers "D"=DNA, "N"=1 to 50 or more, but is optionally 1-8 or 1-10. "N*"=0 to 15 or more, but is optionally 0, 1, 2, 3, 4, 5 or 6. "Z"=DNA or RNA. In one embodiment, the top strand is the sense strand, and the bottom strand is the antisense strand. Alternatively, the bottom strand is the sense strand and the top strand is the antisense strand, with 2'-O-methyl RNA monomers located at alternating residues along the top strand, rather than the bottom strand presently depicted in the above schematic.

In another such embodiment, the DsiRNA comprises:

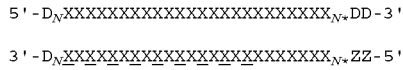

wherein "X"=RNA, optionally a 2'-O-methyl RNA monomers "D"=DNA, "N"=1 to 50 or more, but is optionally 1-8 or 1-10. "N*"=0 to 15 or more, but is optionally 0, 1, 2, 3, 4, 5 or 6. "Z"=DNA or RNA. In one embodiment, the top strand is the sense strand, and the bottom strand is the antisense strand. Alternatively, the bottom strand is the sense strand and the top strand is the antisense strand, with 2'-O-methyl RNA monomers located at alternating residues along the top strand, rather than the bottom strand presently depicted in the above schematic.

In another such embodiment, the DsiRNA comprises:

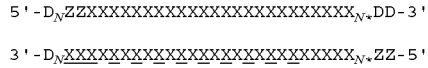

wherein "X"=RNA, "$\underline{X}$"=2'-O-methyl RNA, "D"=DNA, "Z"=DNA or RNA, and "N"=1 to 50 or more, but is optionally 1-8 or 1-10. "N*"=0 to 15 or more, but is optionally 0, 1, 2, 3, 4, 5 or 6. In one embodiment, the top strand is the sense strand, and the bottom strand is the antisense strand. Alternatively, the bottom strand is the sense strand and the top strand is the antisense strand, with 2'-O-methyl RNA monomers located at alternating residues along the top strand, rather than the bottom strand presently depicted in the above schematic.

In another such embodiment, the DsiRNA comprises:

wherein "X"=RNA, "$\underline{X}$"=2'-O-methyl RNA, "D"=DNA, "Z"=DNA or RNA, and "N"=1 to 50 or more, but is optionally 1-8 or 1-10. "N*"=0 to 15 or more, but is optionally 0, 1, 2, 3, 4, 5 or 6. "Y" is an optional overhang domain comprised of 0-10 RNA monomers that are optionally 2'-O-methyl RNA monomers—in certain embodiments, "Y" is an overhang domain comprised of 1-4 RNA monomers that are optionally 2'-O-methyl RNA monomers. In one embodiment, the top strand is the sense strand, and the bottom strand is the antisense strand. Alternatively, the bottom strand is the sense strand and the top strand is the antisense strand, with 2'-O-methyl RNA monomers located at alternating residues along the top strand, rather than the bottom strand presently depicted in the above schematic.

In another embodiment, the DsiRNA comprises:

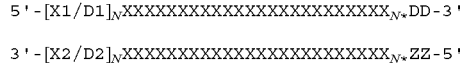

wherein "X"=RNA, "D"=DNA, "Z"=DNA or RNA, and "N"=1 to 50 or more, but is optionally 1-8 or 1-10, where at least one $D1_N$ is present in the top strand and is base paired with a corresponding $D2_N$ in the bottom strand. Optionally, $D1_N$ and $D1_{N+1}$ are base paired with corresponding $D2_N$ and $D2_{N+1}$; $D1_N$, $D1_{N+1}$ and $D1_{N+2}$ are base paired with corresponding $D2_N$, $D1_{N+1}$ and $D1_{N+2}$, etc. "N*"=0 to 15 or more, but is optionally 0, 1, 2, 3, 4, 5 or 6. In one embodiment, the top strand is the sense strand, and the bottom strand is the antisense strand. Alternatively, the bottom strand is the sense strand and the top strand is the antisense strand, with 2'-O-methyl RNA monomers located at alternating residues along the top strand, rather than the bottom strand presently depicted in the above schematic.

In a related embodiment, the DsiRNA comprises:

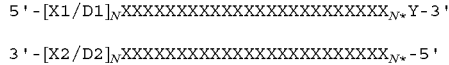

wherein "X"=RNA, "D"=DNA, "Y" is an optional overhang domain comprised of 0-10 RNA monomers that are optionally 2'-O-methyl RNA monomers—in certain embodiments, "Y" is an overhang domain comprised of 1-4 RNA monomers that are optionally 2'-O-methyl RNA monomers, and "N"=1 to 50 or more, but is optionally 1-8 or 1-10, where at least one $D1_N$ is present in the top strand and is base paired with a corresponding $D2_N$ in the bottom strand. Optionally, $D1_N$ and $D1_{N+1}$ are base paired with corresponding $D2_N$ and $D2_{N+1}$; $D1_N$, $D1_{N+1}$ and $D1_{N+2}$ are base paired with corresponding $D2_N$, $D1_{N+1}$ and $D1_{N+2}$, etc. "N*"=0 to 15 or more, but is optionally 0, 1, 2, 3, 4, 5 or 6. In one embodiment, the top strand is the sense strand, and the bottom strand is the antisense strand. Alternatively, the bottom strand is the sense strand and the top strand is the antisense strand, with 2'-O-methyl RNA monomers located at alternating residues along the top strand, rather than the bottom strand presently depicted in the above schematic.

In another embodiment, the DNA:DNA-extended DsiRNA comprises strands having equal lengths possessing 1-3 mismatched residues that serve to orient Dicer cleavage (specifically, one or more of positions 1, 2 or 3 on the first strand of the DsiRNA, when numbering from the 3'-terminal residue, are mismatched with corresponding residues of the 5'-terminal region on the second strand when first and second strands are annealed to one another). An exemplary DNA:DNA-extended DsiRNA agent with two terminal mismatched residues is shown:

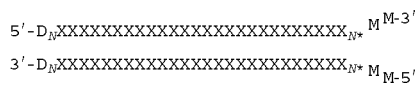

wherein "X"=RNA, "M"=Nucleic acid residues (RNA, DNA or non-natural or modified nucleic acids) that do not base pair (hydrogen bond) with corresponding "M" residues of otherwise complementary strand when strands are annealed, "D"=DNA and "N"=1 to 50 or more, but is optionally 1-8 or 1-10. "N*"=0 to 15 or more, but is optionally 0, 1, 2, 3, 4, 5 or 6. Any of the residues of such agents can optionally be 2'-O-methyl RNA monomers—alternating positioning of 2'-O-methyl RNA monomers that commences from the 3'-terminal residue of the bottom (second) strand, as shown for above asymmetric agents, can also be used in the above "blunt/fray" DsiRNA agent. In one embodiment, the top strand (first strand) is the sense strand, and the bottom strand (second strand) is the antisense strand. Alternatively, the bottom strand is the sense strand and the top strand is the antisense strand. Modification and DNA:DNA extension patterns paralleling those shown above for asymmetric/overhang agents can also be incorporated into such "blunt/frayed" agents.

In another embodiment, a length-extended DsiRNA agent is provided that comprises deoxyribonucleotides positioned at sites modeled to function via specific direction of Dicer cleavage, yet which does not require the presence of a base-paired deoxyribonucleotide in the dsRNA structure. Exemplary structures for such a molecule are shown:

```
5'-XXDDXXXXXXXXXXXXXXXXXXXX_{N*}Y-3'

3'-DDXXXXXXXXXXXXXXXXXXXXXX_{N*}-5'
or

5'-XDXDXXXXXXXXXXXXXXXXXXXX_{N*}Y-3'

3'-DXDXXXXXXXXXXXXXXXXXXXXX_{N*}-5'
``` wherein "X"=RNA, "Y" is an optional overhang domain comprised of 0-10 RNA monomers that are optionally 2'-O-methyl RNA monomers—in certain embodiments, "Y" is an overhang domain comprised of 1-4 RNA monomers that are optionally 2'-O-methyl RNA monomers, and "D"=DNA. "N*"=0 to 15 or more, but is optionally 0, 1, 2, 3, 4, 5 or 6. In one embodiment, the top strand is the sense strand, and the bottom strand is the antisense strand. Alternatively, the bottom strand is the sense strand and the top strand is the antisense strand.

In any of the above embodiments where the bottom strand of the above structure is the antisense strand, the positioning of two deoxyribonucleotide residues at the ultimate and penultimate residues of the 5' end of the antisense strand will help reduce off-target effects (as prior studies have shown a 2'-O-methyl modification of at least the penultimate position from the 5' terminus of the antisense strand to reduce off-target effects; see, e.g., US 2007/0223427).

In certain embodiments, the "D" residues of the above structures include at least one PS-DNA or PS-RNA. Optionally, the "D" residues of the above structures include at least one modified nucleotide that inhibits Dicer cleavage.

While the above-described "DNA-extended" DsiRNA agents can be categorized as either "left extended" or "right extended", DsiRNA agents comprising both left- and right-extended DNA-containing sequences within a single agent (e.g., both flanks surrounding a core dsRNA structure are dsDNA extensions) can also be generated and used in similar manner to those described herein for "right-extended" and "left-extended" agents.

In some embodiments, the DsiRNA of the instant invention further comprises a linking moiety or domain that joins the sense and antisense strands of a dsNA of the invention, e.g., a DNA:DNA-extended DsiRNA agent. Optionally, such a linking moiety domain joins the 3' end of the sense strand and the 5' end of the antisense strand. The linking moiety may be a chemical (non-nucleotide) linker, such as an oligomethylenediol linker, oligoethylene glycol linker, or other art-recognized linker moiety. Alternatively, the linker can be a nucleotide linker, optionally including an extended loop and/or tetraloop.

In one embodiment, the DsiRNA agent has an asymmetric structure, with the sense strand having a 25-base pair length, and the antisense strand having a 27-base pair length with a 1-4 base 3'-overhang (e.g., a one base 3'-overhang, a two base 3'-overhang, a three base 3'-overhang or a four base 3'-overhang). In another embodiment, this DsiRNA agent has an asymmetric structure further containing 2 deoxynucleotides at the 3' end of the sense strand.

In another embodiment, the DsiRNA agent has an asymmetric structure, with the antisense strand having a 25-base pair length, and the sense strand having a 27-base pair length with a 1-4 base 3'-overhang (e.g., a one base 3'-overhang, a two base 3'-overhang, a three base 3'-overhang or a four base 3'-overhang). In another embodiment, this DsiRNA agent has an asymmetric structure further containing 2 deoxyribonucleotides at the 3' end of the antisense strand.

Exemplary Lactate Dehydrogenase targeting DsiRNA agents of the invention, and their associated lactate dehydrogenase target sequences, include the following, presented in the below series of tables:
Table Number:
(2) Selected Human Anti-Lactate Dehydrogenase DsiRNA Agents (Asymmetrics);
(3) Selected Human Anti-Lactate Dehydrogenase DsiRNAs, Unmodified Duplexes (Asymmetrics);
(4) DsiRNA Target Sequences (21mers) in Human Lactate Dehydrogenase mRNA;
(5) Selected Human Anti-Lactate Dehydrogenase "Blunt/Blunt" DsiRNAs;
(6) DsiRNA Component 19 Nucleotide Target Sequences in Human Lactate Dehydrogenase mRNA;
(7) Selected Mouse Anti-Lactate Dehydrogenase DsiRNA Agents (Asymmetrics);
(8) Selected Mouse Anti-Lactate Dehydrogenase DsiRNAs, Unmodified Duplexes (Asymmetrics);
(9) DsiRNA Target Sequences (21mers) in Mouse Lactate Dehydrogenase mRNA;
(10) Selected Mouse Anti-Lactate Dehydrogenase "Blunt/Blunt" DsiRNAs;
(11) DsiRNA Component 19 Nucleotide Target Sequences in Mouse Lactate Dehydrogenase mRNA; and
(12) Additional Selected Human Anti-Lactate Dehydrogenase DsiRNA Agents (Asymmetrics)

TABLE 2

Selected Human Anti-Lactate Dehydrogenase DsiRNA Agents (Asymmetries)

| | | |
|---|---|---|
| | 5'-AG<u>AA</u>UAAGAUUAC<u>A</u>G<u>UU</u>GUUGGGgt-3' | (SEQ ID NO: 1) |
| | 3'-<u>GGUCUU</u>AUUCUAAUG<u>UC</u>AACAAC<u>CCCA</u>-5' | (SEQ ID NO: 73) |
| LDHA-355 Target: | 5'-CCAGAATAAGATTACAGTTGTTGGGGT-3' | (SEQ ID NO: 145) |
| | 5'-G<u>AA</u>UAAGAUUAC<u>A</u>G<u>UU</u>GUUGGGGtt-3' | (SEQ ID NO: 2) |
| | 3'-<u>GUCUU</u>AUUCUAAUG<u>UC</u><u>AA</u>CAACC<u>CCAA</u>-5' | (SEQ ID NO: 74) |
| LDHA-356 Target: | 5'-CAGAATAAGATTACAGTTGTTGGGGTT-3' | (SEQ ID NO: 146) |
| | 5'-A<u>AG</u>AUUACAGUUG<u>UU</u>GGGGUUGGtg-3' | (SEQ ID NO: 3) |
| | 3'-<u>UAUU</u>CUAAUGUCAAC<u>AA</u>CCCCAA<u>CC</u>AC-5' | (SEQ ID NO: 75) |
| LDHA-360 Target: | 5'-ATAAGATTACAGTTGTTGGGGTTGGTG-3' | (SEQ ID NO: 147) |
| | 5'-AG<u>A</u>UUACAGUUGU<u>U</u>GGGGUUGGUgc-3' | (SEQ ID NO: 4) |
| | 3'-<u>AUUCU</u>AAUGUCAAC<u>AA</u>CCCCAAC<u>CACG</u>-5' | (SEQ ID NO: 76) |
| LDHA-361 Target: | 5'-TAAGATTACAGTTGTTGGGGTTGGTGC-3' | (SEQ ID NO: 148) |

TABLE 2-continued

Selected Human Anti-Lactate Dehydrogenase DsiRNA Agents (Asymmetries)

|  |  |  |
|---|---|---|
| LDHA-362 Target: | 5'-GAUUACAGUUGUUGGGGUUGGUGct-3'<br>3'-UUCUAAUGUCAACAACCCCAACCACGA-5'<br>5'-AAGATTACAGTTGTTGGGGTTGGTGCT-3' | (SEQ ID NO: 5)<br>(SEQ ID NO: 77)<br>(SEQ ID NO: 149) |
| LDHA-363 Target: | 5'-AUUACAGUUGUUGGGGUUGGUGCtg-3'<br>3'-UCUAAUGUCAACAACCCCAACCACGAC-5'<br>5'-AGATTACAGTTGTTGGGGTTGGTGCTG-3' | (SEQ ID NO: 6)<br>(SEQ ID NO: 78)<br>(SEQ ID NO: 150) |
| LDHA-364 Target: | 5'-UUACAGUUGUUGGGGUUGGUGCUgt-3'<br>3'-CUAAUGUCAACAACCCCAACCACGACA-5'<br>5'-GATTACAGTTGTTGGGGTTGGTGCTGT-3' | (SEQ ID NO: 7)<br>(SEQ ID NO: 79)<br>(SEQ ID NO: 151) |
| LDHA-365 Target: | 5'-UACAGUUGUUGGGGUUGGUGCUGtt-3'<br>3'-UAAUGUCAACAACCCCAACCACGACAA-5'<br>5'-ATTACAGTTGTTGGGGTTGGTGCTGTT-3' | (SEQ ID NO: 8)<br>(SEQ ID NO: 80)<br>(SEQ ID NO: 152) |
| LDHA-366 Target: | 5'-ACAGUUGUUGGGGUUGGUGCUGUtg-3'<br>3'-AAUGUCAACAACCCCAACCACGACAAC-5'<br>5'-TTACAGTTGTTGGGGTTGGTGCTGTTG-3' | (SEQ ID NO: 9)<br>(SEQ ID NO: 81)<br>(SEQ ID NO: 153) |
| LDHA-367 Target: | 5'-CAGUUGUUGGGGUUGGUGCUGUUgg-3'<br>3'-AUGUCAACAACCCCAACCACGACAACC-5'<br>5'-TACAGTTGTTGGGGTTGGTGCTGTTGG-3' | (SEQ ID NO: 10)<br>(SEQ ID NO: 82)<br>(SEQ ID NO: 154) |
| LDHA-369 Target: | 5'-GUUGUUGGGGUUGGUGCUGUUGGca-3'<br>3'-GUCAACAACCCCAACCACGACAACCGU-5'<br>5'-CAGTTGTTGGGGTTGGTGCTGTTGGCA-3' | (SEQ ID NO: 11)<br>(SEQ ID NO: 83)<br>(SEQ ID NO: 155) |
| LDHA-370 Target: | 5'-UUGUUGGGGUUGGUGCUGUUGGCat-3'<br>3'-UCAACAACCCCAACCACGACAACCGUA-5'<br>5'-AGTTGTTGGGGTTGGTGCTGTTGGCAT-3' | (SEQ ID NO: 12)<br>(SEQ ID NO: 84)<br>(SEQ ID NO: 156) |
| LDHA-397 Target: | 5'-CCUGUGCCAUCAGUAUCUUAAUGaa-3'<br>3'-CCGGACACGGUAGUCAUAGAAUUACUU-5'<br>5'-GGCCTGTGCCATCAGTATCTTAATGAA-3' | (SEQ ID NO: 13)<br>(SEQ ID NO: 85)<br>(SEQ ID NO: 157) |
| LDHA-398 Target: | 5'-CUGUGCCAUCAGUAUCUUAAUGAag-3'<br>3'-CGGACACGGUAGUCAUAGAAUUACUUC-5'<br>5'-GCCTGTGCCATCAGTATCTTAATGAAG-3' | (SEQ ID NO: 14)<br>(SEQ ID NO: 86)<br>(SEQ ID NO: 158) |
| LDHA-399 Target: | 5'-UGUGCCAUCAGUAUCUUAAUGAAgg-3'<br>3'-GGACACGGUAGUCAUAGAAUUACUUCC-5'<br>5'-CCTGTGCCATCAGTATCTTAATGAAGG-3' | (SEQ ID NO: 15)<br>(SEQ ID NO: 87)<br>(SEQ ID NO: 159) |
| LDHA-400 Target: | 5'-GUGCCAUCAGUAUCUUAAUGAAGga-3'<br>3'-GACACGGUAGUCAUAGAAUUACUUCCU-5'<br>5'-CTGTGCCATCAGTATCTTAATGAAGGA-3' | (SEQ ID NO: 16)<br>(SEQ ID NO: 88)<br>(SEQ ID NO: 160) |
| LDHA-401 Target: | 5'-UGCCAUCAGUAUCUUAAUGAAGGac-3'<br>3'-ACACGGUAGUCAUAGAAUUACUUCCUG-5'<br>5'-TGTGCCATCAGTATCTTAATGAAGGAC-3' | (SEQ ID NO: 17)<br>(SEQ ID NO: 89)<br>(SEQ ID NO: 161) |
| LDHA-402 Target: | 5'-GCCAUCAGUAUCUUAAUGAAGGAct-3'<br>3'-CACGGUAGUCAUAGAAUUACUUCCUGA-5'<br>5'-GTGCCATCAGTATCTTAATGAAGGACT-3' | (SEQ ID NO: 18)<br>(SEQ ID NO: 90)<br>(SEQ ID NO: 162) |
| LDHA-403 Target: | 5'-CCAUCAGUAUCUUAAUGAAGGACtt-3'<br>3'-ACGGUAGUCAUAGAAUUACUUCCUGAA-5'<br>5'-TGCCATCAGTATCTTAATGAAGGACTT-3' | (SEQ ID NO: 19)<br>(SEQ ID NO: 91)<br>(SEQ ID NO: 163) |
| LDHA-404 Target: | 5'-CAUCAGUAUCUUAAUGAAGGACUtg-3'<br>3'-CGGUAGUCAUAGAAUUACUUCCUGAAC-5'<br>5'-GCCATCAGTATCTTAATGAAGGACTTG-3' | (SEQ ID NO: 20)<br>(SEQ ID NO: 92)<br>(SEQ ID NO: 164) |
| LDHA-714 Target: | 5'-GUGGAUAUCUUGACCUACGUGGCtt-3'<br>3'-GUCACCUAUAGAACUGGAUGCACCGAA-5'<br>5'-CAGTGGATATCTTGACCTACGTGGCTT-3' | (SEQ ID NO: 21)<br>(SEQ ID NO: 93)<br>(SEQ ID NO: 165) |
| LDHA-717 Target: | 5'-GAUAUCUUGACCUACGUGGCUUGga-3'<br>3'-ACCUAUAGAACUGGAUGCACCGAACCU-5'<br>5'-TGGATATCTTGACCTACGTGGCTTGGA-3' | (SEQ ID NO: 22)<br>(SEQ ID NO: 94)<br>(SEQ ID NO: 166) |
| LDHA-718 Target: | 5'-AUAUCUUGACCUACGUGGCUUGGaa-3'<br>3'-CCUAUAGAACUGGAUGCACCGAACCUU-5'<br>5'-GGATATCTTGACCTACGTGGCTTGGAA-3' | (SEQ ID NO: 23)<br>(SEQ ID NO: 95)<br>(SEQ ID NO: 167) |

TABLE 2-continued

Selected Human Anti-Lactate Dehydrogenase DsiRNA Agents (Asymmetries)

|  |  |  |
|---|---|---|
| LDHA-719 Target: | 5'-UAUCUUGACCUACGUGGCUUGGAag-3'<br>3'-CUAUAGAACUGGAUGCACCGAACCUUC-5'<br>5'-GATATCTTGACCTACGTGGCTTGGAAG-3' | (SEQ ID NO: 24)<br>(SEQ ID NO: 96)<br>(SEQ ID NO: 168) |
| LDHA-720 Target: | 5'-AUCUUGACCUACGUGGCUUGGAAga-3'<br>3'-UAUAGAACUGGAUGCACCGAACCUUCU-5'<br>5'-ATATCTTGACCTACGTGGCTTGGAAGA-3' | (SEQ ID NO: 25)<br>(SEQ ID NO: 97)<br>(SEQ ID NO: 169) |
| LDHA-722 Target: | 5'-CUUGACCUACGUGGCUUGGAAGAta-3'<br>3'-UAGAACUGGAUGCACCGAACCUUCUAU-5'<br>5'-ATCTTGACCTACGTGGCTTGGAAGATA-3' | (SEQ ID NO: 26)<br>(SEQ ID NO: 98)<br>(SEQ ID NO: 170) |
| LDHA-723 Target: | 5'-UUGACCUACGUGGCUUGGAAGAUaa-3'<br>3'-AGAACUGGAUGCACCGAACCUUCUAUU-5'<br>5'-TCTTGACCTACGTGGCTTGGAAGATAA-3' | (SEQ ID NO: 27)<br>(SEQ ID NO: 99)<br>(SEQ ID NO: 171) |
| LDHA-724 Target: | 5'-UGACCUACGUGGCUUGGAAGAUAag-3'<br>3'-GAACUGGAUGCACCGAACCUUCUAUUC-5'<br>5'-CTTGACCTACGTGGCTTGGAAGATAAG-3' | (SEQ ID NO: 28)<br>(SEQ ID NO: 100)<br>(SEQ ID NO: 172) |
| LDHA-739 Target: | 5'-GGAAGAUAAGUGGUUUUCCCAAAaa-3'<br>3'-AACCUUCUAUUCACCAAAAGGGUUUUU-5'<br>5'-TTGGAAGATAAGTGGTTTTCCCAAAAA-3' | (SEQ ID NO: 29)<br>(SEQ ID NO: 101)<br>(SEQ ID NO: 173) |
| LDHA-740 Target: | 5'-GAAGAUAAGUGGUUUUCCCAAAAac-3'<br>3'-ACCUUCUAUUCACCAAAAGGGUUUUUG-5'<br>5'-TGGAAGATAAGTGGTTTTCCCAAAAAC-3' | (SEQ ID NO: 30)<br>(SEQ ID NO: 102)<br>(SEQ ID NO: 174) |
| LDHA-891 Target: | 5'-CCUGUAUGGAGUGGAAUGAAUGUtg-3'<br>3'-ACGGACAUACCUCACCUUACUUACAAC-5'<br>5'-TGCCTGTATGGAGTGGAATGAATGTTG-3' | (SEQ ID NO: 31)<br>(SEQ ID NO: 103)<br>(SEQ ID NO: 175) |
| LDHA-892 Target: | 5'-CUGUAUGGAGUGGAAUGAAUGUUgc-3'<br>3'-CGGACAUACCUCACCUUACUUACAACG-5'<br>5'-GCCTGTATGGAGTGGAATGAATGTTGC-3' | (SEQ ID NO: 32)<br>(SEQ ID NO: 104)<br>(SEQ ID NO: 176) |
| LDHA-907 Target: | 5'-UGAAUGUUGCUGGUGUCUCUCUGaa-3'<br>3'-UUACUUACAACGACCACAGAGAGACUU-5'<br>5'-AATGAATGTTGCTGGTGTCTCTCTGAA-3' | (SEQ ID NO: 33)<br>(SEQ ID NO: 105)<br>(SEQ ID NO: 177) |
| LDHA-952 Target: | 5'-GGACUGAUAAAGAUAAGGAACAGtg-3'<br>3'-UCCCUGACUAUUUCUAUUCCUUGUCAC-5'<br>5'-AGGGACTGATAAAGATAAGGAACAGTG-3' | (SEQ ID NO: 34)<br>(SEQ ID NO: 106)<br>(SEQ ID NO: 178) |
| LDHA-1286 Target: | 5'-GCAAUUUUAAAGUCUUCUGAUGUca-3'<br>3'-GACGUUAAAAUUUCAGAAGACUACAGU-5'<br>5'-CTGCAATTTTAAAGTCTTCTGATGTCA-3' | (SEQ ID NO: 35)<br>(SEQ ID NO: 107)<br>(SEQ ID NO: 179) |
| LDHA-1287 Target: | 5'-CAAUUUUAAAGUCUUCUGAUGUCat-3'<br>3'-ACGUUAAAAUUUCAGAAGACUACAGUA-5'<br>5'-TGCAATTTTAAAGTCTTCTGATGTCAT-3' | (SEQ ID NO: 36)<br>(SEQ ID NO: 108)<br>(SEQ ID NO: 180) |
| LDHA-1292 Target: | 5'-UUAAAGUCUUCUGAUGUCAUAUCat-3'<br>3'-AAAAUUUCAGAAGACUACAGUAUAGUA-5'<br>5'-TTTTAAAGTCTTCTGATGTCATATCAT-3' | (SEQ ID NO: 37)<br>(SEQ ID NO: 109)<br>(SEQ ID NO: 181) |
| LDHA-1293 Target: | 5'-UAAAGUCUUCUGAUGUCAUAUCAtt-3'<br>3'-AAAUUUCAGAAGACUACAGUAUAGUAA-5'<br>5'-TTTAAAGTCTTCTGATGTCATATCATT-3' | (SEQ ID NO: 38)<br>(SEQ ID NO: 110)<br>(SEQ ID NO: 182) |
| LDHA-1294 Target: | 5'-AAAGUCUUCUGAUGUCAUAUCAUtt-3'<br>3'-AAUUUCAGAAGACUACAGUAUAGUAAA-5'<br>5'-TTAAAGTCTTCTGATGTCATATCATTT-3' | (SEQ ID NO: 39)<br>(SEQ ID NO: 111)<br>(SEQ ID NO: 183) |
| LDHA-1359 Target: | 5'-CAUGUUGUCCUUUUUAUCUGAUCtg-3'<br>3'-ACGUACAACAGGAAAAAUAGACUAGAC-5'<br>5'-TGCATGTTGTCCTTTTTATCTGATCTG-3' | (SEQ ID NO: 40)<br>(SEQ ID NO: 112)<br>(SEQ ID NO: 184) |
| LDHA-1360 Target: | 5'-AUGUUGUCCUUUUUAUCUGAUCgt-3'<br>3'-CGUACAACAGGAAAAAUAGACUAGACA-5'<br>5'-GCATGTTGTCCTTTTTATCTGATCTGT-3' | (SEQ ID NO: 41)<br>(SEQ ID NO: 113)<br>(SEQ ID NO: 185) |
| LDHA-1361 Target: | 5'-UGUUGUCCUUUUUAUCUGAUCUGtg-3'<br>3'-GUACAACAGGAAAAAUAGACUAGACAC-5'<br>5'-CATGTTGTCCTTTTTATCTGATCTGTG-3' | (SEQ ID NO: 42)<br>(SEQ ID NO: 114)<br>(SEQ ID NO: 186) |

TABLE 2-continued

Selected Human Anti-Lactate Dehydrogenase DsiRNA Agents (Asymmetries)

|  |  |  |  |
|---|---|---|---|
| LDHA-1362 | Target: | 5'-GUUGUCCUUUUUAUCUGAUCUGUga-3'<br>3'-UACAACAGGAAAAAUAGACUAGACACU-5'<br>5'-ATGTTGTCCTTTTTATCTGATCTGTGA-3' | (SEQ ID NO: 43)<br>(SEQ ID NO: 115)<br>(SEQ ID NO: 187) |
| LDHA-1363 | Target: | 5'-UUGUCCUUUUUAUCUGAUCUGUGat-3'<br>3'-ACAACAGGAAAAAUAGACUAGACACUA-5'<br>5'-TGTTGTCCTTTTTATCTGATCTGTGAT-3' | (SEQ ID NO: 44)<br>(SEQ ID NO: 116)<br>(SEQ ID NO: 188) |
| LDHA-1365 | Target: | 5'-GUCCUUUUUAUCUGAUCUGUGAUta-3'<br>3'-AACAGGAAAAAUAGACUAGACACUAAU-5'<br>5'-TTGTCCTTTTTATCTGATCTGTGATTA-3' | (SEQ ID NO: 45)<br>(SEQ ID NO: 117)<br>(SEQ ID NO: 189) |
| LDHA-1366 | Target: | 5'-UCCUUUUUAUCUGAUCUGUGAUUaa-3'<br>3'-ACAGGAAAAAUAGACUAGACACUAAUU-5'<br>5'-TGTCCTTTTTATCTGATCTGTGATTAA-3' | (SEQ ID NO: 46)<br>(SEQ ID NO: 118)<br>(SEQ ID NO: 190) |
| LDHA-1367 | Target: | 5'-CCUUUUUAUCUGAUCUGUGAUUAaa-3'<br>3'-CAGGAAAAAUAGACUAGACACUAAUUU-5'<br>5'-GTCCTTTTTATCTGATCTGTGATTAAA-3' | (SEQ ID NO: 47)<br>(SEQ ID NO: 119)<br>(SEQ ID NO: 191) |
| LDHA-1368 | Target: | 5'-CUUUUUAUCUGAUCUGUGAUUAAag-3'<br>3'-AGGAAAAAUAGACUAGACACUAAUUUC-5'<br>5'-TCCTTTTTATCTGATCTGTGATTAAAG-3' | (SEQ ID NO: 48)<br>(SEQ ID NO: 120)<br>(SEQ ID NO: 192) |
| LDHA-1370 | Target: | 5'-UUUUAUCUGAUCUGUGAUUAAAGca-3'<br>3'-GAAAAAUAGACUAGACACUAAUUUCGU-5'<br>5'-CTTTTTATCTGATCTGTGATTAAAGCA-3' | (SEQ ID NO: 49)<br>(SEQ ID NO: 121)<br>(SEQ ID NO: 193) |
| LDHA-1371 | Target: | 5'-UUUAUCUGAUCUGUGAUUAAAGCag-3'<br>3'-AAAAAUAGACUAGACACUAAUUUCGUC-5'<br>5'-TTTTTATCTGATCTGTGATTAAAGCAG-3' | (SEQ ID NO: 50)<br>(SEQ ID NO: 122)<br>(SEQ ID NO: 194) |
| LDHA-1372 | Target: | 5'-UUAUCUGAUCUGUGAUUAAAGCAgt-3'<br>3'-AAAAUAGACUAGACACUAAUUUCGUCA-5'<br>5'-TTTTATCTGATCTGTGATTAAAGCAGT-3' | (SEQ ID NO: 51)<br>(SEQ ID NO: 123)<br>(SEQ ID NO: 195) |
| LDHA-1393 | Target: | 5'-CAGUAAUAUUUUAAGAUGGACUGgg-3'<br>3'-UCGUCAUUAUAAAAUUCUACCUGACCC-5'<br>5'-AGCAGTAATATTTTAAGATGGACTGGG-3' | (SEQ ID NO: 52)<br>(SEQ ID NO: 124)<br>(SEQ ID NO: 196) |
| LDHA-1427 | Target: | 5'-AACUCCUGAAGUUAGAAAUAAGAat-3'<br>3'-AGUUGAGGACUUCAAUCUUUAUUCUUA-5'<br>5'-TCAACTCCTGAAGTTAGAAATAAGAAT-3' | (SEQ ID NO: 53)<br>(SEQ ID NO: 125)<br>(SEQ ID NO: 197) |
| LDHA-1428 | Target: | 5'-ACUCCUGAAGUUAGAAAUAAGAAtg-3'<br>3'-GUUGAGGACUUCAAUCUUUAUUCUUAC-5'<br>5'-CAACTCCTGAAGTTAGAAATAAGAATG-3' | (SEQ ID NO: 54)<br>(SEQ ID NO: 126)<br>(SEQ ID NO: 198) |
| LDHA-1512 | Target: | 5'-AACUGGUUAGUGUGAAAUAGUUCtg-3'<br>3'-AGUUGACCAAUCACACUUUAUCAAGAC-5'<br>5'-TCAACTGGTTAGTGTGAAATAGTTCTG-3' | (SEQ ID NO: 55)<br>(SEQ ID NO: 127)<br>(SEQ ID NO: 199) |
| LDHA-1513 | Target: | 5'-ACUGGUUAGUGUGAAAUAGUUCUgc-3'<br>3'-GUUGACCAAUCACACUUUAUCAAGACG-5'<br>5'-CAACTGGTTAGTGTGAAATAGTTCTGC-3' | (SEQ ID NO: 56)<br>(SEQ ID NO: 128)<br>(SEQ ID NO: 200) |
| LDHA-1514 | Target: | 5'-CUGGUUAGUGUGAAAUAGUUCUGcc-3'<br>3'-UUGACCAAUCACACUUUAUCAAGACGG-5'<br>5'-AACTGGTTAGTGTGAAATAGTTCTGCC-3' | (SEQ ID NO: 57)<br>(SEQ ID NO: 129)<br>(SEQ ID NO: 201) |
| LDHA-1516 | Target: | 5'-GGUUAGUGUGAAAUAGUUCUGCCac-3'<br>3'-GACCAAUCACACUUUAUCAAGACGGUG-5'<br>5'-CTGGTTAGTGTGAAATAGTTCTGCCAC-3' | (SEQ ID NO: 58)<br>(SEQ ID NO: 130)<br>(SEQ ID NO: 202) |
| LDHA-1684 | Target: | 5'-AUCCAGUGUAUAAAUCCAAUAUCat-3'<br>3'-CCUAGGUCACAUAUUUAGGUUAUAGUA-5'<br>5'-GGATCCAGTGTATAAATCCAATATCAT-3' | (SEQ ID NO: 59)<br>(SEQ ID NO: 131)<br>(SEQ ID NO: 203) |
| LDHA-1688 | Target: | 5'-AGUGUAUAAAUCCAAUAUCAUGUct-3'<br>3'-GGUCACAUAUUUAGGUUAUAGUACAGA-5'<br>5'-CCAGTGTATAAATCCAATATCATGTCT-3' | (SEQ ID NO: 60)<br>(SEQ ID NO: 132)<br>(SEQ ID NO: 204) |
| LDHA-1736 | Target: | 5'-CUUAUUUUGUGAACUAUAUCAGUag-3'<br>3'-UAGAAUAAAACACUUGAUAUAGUCAUC-5'<br>5'-ATCTTATTTTGTGAACTATATCAGTAG-3' | (SEQ ID NO: 61)<br>(SEQ ID NO: 133)<br>(SEQ ID NO: 205) |

TABLE 2-continued

Selected Human Anti-Lactate Dehydrogenase DsiRNA Agents (Asymmetries)

|  |  |  |
|---|---|---|
| LDHA-1750 Target: | 5'-UAUAUCAGUAGUGUACAUUACCAta-3'<br>3'-UGAUAUAGUCAUCACAUGUAAUGGUAU-5'<br>5'-ACTATATCAGTAGTGTACATTACCATA-3' | (SEQ ID NO: 62)<br>(SEQ ID NO: 134)<br>(SEQ ID NO: 206) |
| LDHA-1753 Target: | 5'-AUCAGUAGUGUACAUUACCAUAUaa-3'<br>3'-UAUAGUCAUCACAUGUAAUGGUAUAUU-5'<br>5'-ATATCAGTAGTGTACATTACCATATAA-3' | (SEQ ID NO: 63)<br>(SEQ ID NO: 135)<br>(SEQ ID NO: 207) |
| LDHA-1754 Target: | 5'-UCAGUAGUGUACAUUACCAUAUAat-3'<br>3'-AUAGUCAUCACAUGUAAUGGUAUAUUA-5'<br>5'-TATCAGTAGTGTACATTACCATATAAT-3' | (SEQ ID NO: 64)<br>(SEQ ID NO: 136)<br>(SEQ ID NO: 208) |
| LDHA-1805 Target: | 5'-CAACCAACUAUCCAAGUGUUAUAcc-3'<br>3'-ACGUUGGUUGAUAGGUUCACAAUAUGG-5'<br>5'-TGCAACCAACTATCCAAGTGTTATACC-3' | (SEQ ID NO: 65)<br>(SEQ ID NO: 137)<br>(SEQ ID NO: 209) |
| LDHA-1806 Target: | 5'-AACCAACUAUCCAAGUGUUAUACca-3'<br>3'-CGUUGGUUGAUAGGUUCACAAUAUGGU-5'<br>5'-GCAACCAACTATCCAAGTGTTATACCA-3' | (SEQ ID NO: 66)<br>(SEQ ID NO: 138)<br>(SEQ ID NO: 210) |
| LDHA-1807 Target: | 5'-ACCAACUAUCCAAGUGUUAUACCaa-3'<br>3'-GUUGGUUGAUAGGUUCACAAUAUGGUU-5'<br>5'-CAACCAACTATCCAAGTGTTATACCAA-3' | (SEQ ID NO: 67)<br>(SEQ ID NO: 139)<br>(SEQ ID NO: 211) |
| LDHA-1808 Target: | 5'-CCAACUAUCCAAGUGUUAUACCAac-3'<br>3'-UUGGUUGAUAGGUUCACAAUAUGGUUG-5'<br>5'-AACCAACTATCCAAGTGTTATACCAAC-3' | (SEQ ID NO: 68)<br>(SEQ ID NO: 140)<br>(SEQ ID NO: 212) |
| LDHA-1811 Target: | 5'-ACUAUCCAAGUGUUAUACCAACUaa-3'<br>3'-GUUGAUAGGUUCACAAUAUGGUUGAUU-5'<br>5'-CAACTATCCAAGTGTTATACCAACTAA-3' | (SEQ ID NO: 69)<br>(SEQ ID NO: 141)<br>(SEQ ID NO: 213) |
| LDHA-1812 Target: | 5'-CUAUCCAAGUGUUAUACCAACUAaa-3'<br>3'-UUGAUAGGUUCACAAUAUGGUUGAUUU-5'<br>5'-AACTATCCAAGTGTTATACCAACTAAA-3' | (SEQ ID NO: 70)<br>(SEQ ID NO: 142)<br>(SEQ ID NO: 214) |
| LDHA-1815 Target: | 5'-UCCAAGUGUUAUACCAACUAAAAcc-3'<br>3'-AUAGGUUCACAAUAUGGUUGAUUUUGG-5'<br>5'-TATCCAAGTGTTATACCAACTAAAACC-3' | (SEQ ID NO: 71)<br>(SEQ ID NO: 143)<br>(SEQ ID NO: 215) |
| LDHA-1816 Target: | 5'-CCAAGUGUUAUACCAACUAAAACcc-3'<br>3'-UAGGUUCACAAUAUGGUUGAUUUUGGG-5'<br>5'-ATCCAAGTGTTATACCAACTAAAACCC-3' | (SEQ ID NO: 72)<br>(SEQ ID NO: 144)<br>(SEQ ID NO: 216) |

TABLE 3

Selected Human Anti-Lactate Dehydrogenase DsiRNAs, Unmodified Duplexes (Asymmetrics)

|  |  |  |
|---|---|---|
| LDHA-355 Target: | 5'-AGAAUAAGAUUACAGUUGUUGGGGU-3'<br>3'-GGUCUUAUUCUAAUGUCAACAACCCCA-5'<br>5'-CCAGAATAAGATTACAGTTGTTGGGGT-3' | (SEQ ID NO: 217)<br>(SEQ ID NO: 73)<br>(SEQ ID NO: 145) |
| LDHA-356 Target: | 5'-GAAUAAGAUUACAGUUGUUGGGGUU-3'<br>3'-GUCUUAUUCUAAUGUCAACAACCCCAA-5'<br>5'-CAGAATAAGATTACAGTTGTTGGGGTT-3' | (SEQ ID NO: 218)<br>(SEQ ID NO: 74)<br>(SEQ ID NO: 146) |
| LDHA-360 Target: | 5'-AAGAUUACAGUUGUUGGGGUUGGUG-3'<br>3'-UAUUCUAAUGUCAACAACCCCAACCAC-5'<br>5'-ATAAGATTACAGTTGTTGGGGTTGGTG-3' | (SEQ ID NO: 219)<br>(SEQ ID NO: 75)<br>(SEQ ID NO: 147) |
| LDHA-361 Target: | 5'-AGAUUACAGUUGUUGGGGUUGGUGC-3'<br>3'-AUUCUAAUGUCAACAACCCCAACCACG-5'<br>5'-TAAGATTACAGTTGTTGGGGTTGGTGC-3' | (SEQ ID NO: 220)<br>(SEQ ID NO: 76)<br>(SEQ ID NO: 148) |
| LDHA-362 Target: | 5'-GAUUACAGUUGUUGGGGUUGGUGCU-3'<br>3'-UUCUAAUGUCAACAACCCCAACCACGA-5'<br>5'-AAGATTACAGTTGTTGGGGTTGGTGCT-3' | (SEQ ID NO: 221)<br>(SEQ ID NO: 77)<br>(SEQ ID NO: 149) |
| LDHA-363 Target: | 5'-AUUACAGUUGUUGGGGUUGGUGCUG-3'<br>3'-UCUAAUGUCAACAACCCCAACCACGAC-5'<br>5'-AGATTACAGTTGTTGGGGTTGGTGCTG-3' | (SEQ ID NO: 222)<br>(SEQ ID NO: 78)<br>(SEQ ID NO: 150) |

TABLE 3-continued

Selected Human Anti-Lactate Dehydrogenase DsiRNAs, Unmodified Duplexes (Asymmetrics)

|  |  |  |
|---|---|---|
| LDHA-364 Target: | 5'-UUACAGUUGUUGGGGUUGGUGCUGU-3'<br>3'-CUAAUGUCAACAACCCCAACCACGACA-5'<br>5'-GATTACAGTTGTTGGGGTTGGTGCTGT-3' | (SEQ ID NO: 223)<br>(SEQ ID NO: 79)<br>(SEQ ID NO: 151) |
| LDHA-365 Target: | 5'-UACAGUUGUUGGGGUUGGUGCUGUU-3'<br>3'-UAAUGUCAACAACCCCAACCACGACAA-5'<br>5'-ATTACAGTTGTTGGGGTTGGTGCTGTT-3' | (SEQ ID NO: 224)<br>(SEQ ID NO: 80)<br>(SEQ ID NO: 152) |
| LDHA-366 Target: | 5'-ACAGUUGUUGGGGUUGGUGCUGUUG-3'<br>3'-AAUGUCAACAACCCCAACCACGACAAC-5'<br>5'-TTACAGTTGTTGGGGTTGGTGCTGTTG-3' | (SEQ ID NO: 225)<br>(SEQ ID NO: 81)<br>(SEQ ID NO: 153) |
| LDHA-367 Target: | 5'-CAGUUGUUGGGGUUGGUGCUGUUGG-3'<br>3'-AUGUCAACAACCCCAACCACGACAACC-5'<br>5'-TACAGTTGTTGGGGTTGGTGCTGTTGG-3' | (SEQ ID NO: 226)<br>(SEQ ID NO: 82)<br>(SEQ ID NO: 154) |
| LDHA-369 Target: | 5'-GUUGUUGGGGUUGGUGCUGUUGGCA-3'<br>3'-GUCAACAACCCCAACCACGACAACCGU-5'<br>5'-CAGTTGTTGGGGTTGGTGCTGTTGGCA-3' | (SEQ ID NO: 227)<br>(SEQ ID NO: 83)<br>(SEQ ID NO: 155) |
| LDHA-370 Target: | 5'-UUGUUGGGGUUGGUGCUGUUGGCAU-3'<br>3'-UCAACAACCCCAACCACGACAACCGUA-5'<br>5'-AGTTGTTGGGGTTGGTGCTGTTGGCAT-3' | (SEQ ID NO: 228)<br>(SEQ ID NO: 84)<br>(SEQ ID NO: 156) |
| LDHA-397 Target: | 5'-CCUGUGCCAUCAGUAUCUUAAUGAA-3'<br>3'-CCGGACACGGUAGUCAUAGAAUUACUU-5'<br>5'-GGCCTGTGCCATCAGTATCTTAATGAA-3' | (SEQ ID NO: 229)<br>(SEQ ID NO: 85)<br>(SEQ ID NO: 157) |
| LDHA-398 Target: | 5'-CUGUGCCAUCAGUAUCUUAAUGAAG-3'<br>3'-CGGACACGGUAGUCAUAGAAUUACUUC-5'<br>5'-GCCTGTGCCATCAGTATCTTAATGAAG-3' | (SEQ ID NO: 230)<br>(SEQ ID NO: 86)<br>(SEQ ID NO: 158) |
| LDHA-399 Target: | 5'-UGUGCCAUCAGUAUCUUAAUGAAGG-3'<br>3'-GGACACGGUAGUCAUAGAAUUACUUCC-5'<br>5'-CCTGTGCCATCAGTATCTTAATGAAGG-3' | (SEQ ID NO: 231)<br>(SEQ ID NO: 87)<br>(SEQ ID NO: 159) |
| LDHA-400 Target: | 5'-GUGCCAUCAGUAUCUUAAUGAAGGA-3'<br>3'-GACACGGUAGUCAUAGAAUUACUUCCU-5'<br>5'-CTGTGCCATCAGTATCTTAATGAAGGA-3' | (SEQ ID NO: 232)<br>(SEQ ID NO: 88)<br>(SEQ ID NO: 160) |
| LDHA-401 Target: | 5'-UGCCAUCAGUAUCUUAAUGAAGGAC-3'<br>3'-ACACGGUAGUCAUAGAAUUACUUCCUG-5'<br>5'-TGTGCCATCAGTATCTTAATGAAGGAC-3' | (SEQ ID NO: 233)<br>(SEQ ID NO: 89)<br>(SEQ ID NO: 161) |
| LDHA-402 Target: | 5'-GCCAUCAGUAUCUUAAUGAAGGACU-3'<br>3'-CACGGUAGUCAUAGAAUUACUUCCUGA-5'<br>5'-GTGCCATCAGTATCTTAATGAAGGACT-3' | (SEQ ID NO: 234)<br>(SEQ ID NO: 90)<br>(SEQ ID NO: 162) |
| LDHA-403 Target: | 5'-CCAUCAGUAUCUUAAUGAAGGACUU-3'<br>3'-ACGGUAGUCAUAGAAUUACUUCCUGAA-5'<br>5'-TGCCATCAGTATCTTAATGAAGGACTT-3' | (SEQ ID NO: 235)<br>(SEQ ID NO: 91)<br>(SEQ ID NO: 163) |
| LDHA-404 Target: | 5'-CAUCAGUAUCUUAAUGAAGGACUUG-3'<br>3'-CGGUAGUCAUAGAAUUACUUCCUGAAC-5'<br>5'-GCCATCAGTATCTTAATGAAGGACTTG-3' | (SEQ ID NO: 236)<br>(SEQ ID NO: 92)<br>(SEQ ID NO: 164) |
| LDHA-714 Target: | 5'-GUGGAUAUCUUGACCUACGUGGCUU-3'<br>3'-GUCACCUAUAGAACUGGAUGCACCGAA-5'<br>5'-CAGTGGATATCTTGACCTACGTGGCTT-3' | (SEQ ID NO: 237)<br>(SEQ ID NO: 93)<br>(SEQ ID NO: 165) |
| LDHA-717 Target: | 5'-GAUAUCUUGACCUACGUGGCUUGGA-3'<br>3'-ACCUAUAGAACUGGAUGCACCGAACCU-5'<br>5'-TGGATATCTTGACCTACGTGGCTTGGA-3' | (SEQ ID NO: 238)<br>(SEQ ID NO: 94)<br>(SEQ ID NO: 166) |
| LDHA-718 Target: | 5'-AUAUCUUGACCUACGUGGCUUGGAA-3'<br>3'-CCUAUAGAACUGGAUGCACCGAACCUU-5'<br>5'-GGATATCTTGACCTACGTGGCTTGGAA-3' | (SEQ ID NO: 239)<br>(SEQ ID NO: 95)<br>(SEQ ID NO: 167) |
| LDHA-719 Target: | 5'-UAUCUUGACCUACGUGGCUUGGAAG-3'<br>3'-CUAUAGAACUGGAUGCACCGAACCUUC-5'<br>5'-GATATCTTGACCTACGTGGCTTGGAAG-3' | (SEQ ID NO: 240)<br>(SEQ ID NO: 96)<br>(SEQ ID NO: 168) |
| LDHA-720 Target: | 5'-AUCUUGACCUACGUGGCUUGGAAGA-3'<br>3'-UAUAGAACUGGAUGCACCGAACCUUCU-5'<br>5'-ATATCTTGACCTACGTGGCTTGGAAGA-3' | (SEQ ID NO: 241)<br>(SEQ ID NO: 97)<br>(SEQ ID NO: 169) |

TABLE 3-continued

Selected Human Anti-Lactate Dehydrogenase DsiRNAs, Unmodified Duplexes
(Asymmetrics)

| Name | Sequence | SEQ ID NO |
|---|---|---|
| | 5'-CUUGACCUACGUGGCUUGGAAGAUA-3' | (SEQ ID NO: 242) |
| | 3'-UAGAACUGGAUGCACCGAACCUUCUAU-5' | (SEQ ID NO: 98) |
| LDHA-722 Target: | 5'-ATCTTGACCTACGTGGCTTGGAAGATA-3' | (SEQ ID NO: 170) |
| | 5'-UUGACCUACGUGGCUUGGAAGAUAA-3' | (SEQ ID NO: 243) |
| | 3'-AGAACUGGAUGCACCGAACCUUCUAUU-5' | (SEQ ID NO: 99) |
| LDHA-723 Target: | 5'-TCTTGACCTACGTGGCTTGGAAGATAA-3' | (SEQ ID NO: 171) |
| | 5'-UGACCUACGUGGCUUGGAAGAUAAG-3' | (SEQ ID NO: 244) |
| | 3'-GAACUGGAUGCACCGAACCUUCUAUUC-5' | (SEQ ID NO: 100) |
| LDHA-724 Target: | 5'-CTTGACCTACGTGGCTTGGAAGATAAG-3' | (SEQ ID NO: 172) |
| | 5'-GGAAGAUAAGUGGUUUUCCCAAAAA-3' | (SEQ ID NO: 245) |
| | 3'-AACCUUCUAUUCACCAAAAGGGUUUUU-5' | (SEQ ID NO: 101) |
| LDHA-739 Target: | 5'-TTGGAAGATAAGTGGTTTTCCCAAAAA-3' | (SEQ ID NO: 173) |
| | 5'-GAAGAUAAGUGGUUUUCCCAAAAAC-3' | (SEQ ID NO: 246) |
| | 3'-ACCUUCUAUUCACCAAAAGGGUUUUUG-5' | (SEQ ID NO: 102) |
| LDHA-740 Target: | 5'-TGGAAGATAAGTGGTTTTCCCAAAAAC-3' | (SEQ ID NO: 174) |
| | 5'-CCUGUAUGGAGUGGAAUGAAUGUUG-3' | (SEQ ID NO: 247) |
| | 3'-ACGGACAUACCUCACCUUACUUACAAC-5' | (SEQ ID NO: 103) |
| LDHA-891 Target: | 5'-TGCCTGTATGGAGTGGAATGAATGTTG-3' | (SEQ ID NO: 175) |
| | 5'-CUGUAUGGAGUGGAAUGAAUGUUGC-3' | (SEQ ID NO: 248) |
| | 3'-CGGACAUACCUCACCUUACUUACAACG-5' | (SEQ ID NO: 104) |
| LDHA-892 Target: | 5'-GCCTGTATGGAGTGGAATGAATGTTGC-3' | (SEQ ID NO: 176) |
| | 5'-UGAAUGUUGCUGGUGUCUCUCUGAA-3' | (SEQ ID NO: 249) |
| | 3'-UUACUUACAACGACCACAGAGAGACUU-5' | (SEQ ID NO: 105) |
| LDHA-907 Target: | 5'-AATGAATGTTGCTGGTGTCTCTCTGAA-3' | (SEQ ID NO: 177) |
| | 5'-GGACUGAUAAAGAUAAGGAACAGUG-3' | (SEQ ID NO: 250) |
| | 3'-UCCCUGACUAUUUCUAUUCCUUGUCAC-5' | (SEQ ID NO: 106) |
| LDHA-952 Target: | 5'-AGGGACTGATAAAGATAAGGAACAGTG-3' | (SEQ ID NO: 178) |
| | 5'-GCAAUUUUAAAGUCUUCUGAUGUCA-3' | (SEQ ID NO: 251) |
| | 3'-GACGUUAAAAUUUCAGAAGACUACAGU-5' | (SEQ ID NO: 107) |
| LDHA-1286 Target: | 5'-CTGCAATTTTAAAGTCTTCTGATGTCA-3' | (SEQ ID NO: 179) |
| | 5'-CAAUUUUAAAGUCUUCUGAUGUCAU-3' | (SEQ ID NO: 252) |
| | 3'-ACGUUAAAAUUUCAGAAGACUACAGUA-5' | (SEQ ID NO: 108) |
| LDHA-1287 Target: | 5'-TGCAATTTTAAAGTCTTCTGATGTCAT-3' | (SEQ ID NO: 180) |
| | 5'-UUAAAGUCUUCUGAUGUCAUAUCAU-3' | (SEQ ID NO: 253) |
| | 3'-AAAAUUUCAGAAGACUACAGUAUAGUA-5' | (SEQ ID NO: 109) |
| LDHA-1292 Target: | 5'-TTTTAAAGTCTTCTGATGTCATATCAT-3' | (SEQ ID NO: 181) |
| | 5'-UAAAGUCUUCUGAUGUCAUAUCAUU-3' | (SEQ ID NO: 254) |
| | 3'-AAAUUUCAGAAGACUACAGUAUAGUAA-5' | (SEQ ID NO: 110) |
| LDHA-1293 Target: | 5'-TTTAAAGTCTTCTGATGTCATATCATT-3' | (SEQ ID NO: 182) |
| | 5'-AAAGUCUUCUGAUGUCAUAUCAUUU-3' | (SEQ ID NO: 255) |
| | 3'-AAUUUCAGAAGACUACAGUAUAGUAAA-5' | (SEQ ID NO: 111) |
| LDHA-1294 Target: | 5'-TTAAAGTCTTCTGATGTCATATCATTT-3' | (SEQ ID NO: 183) |
| | 5'-CAUGUUGUCCUUUUUAUCUGAUCUG-3' | (SEQ ID NO: 256) |
| | 3'-ACGUACAACAGGAAAAAUAGACUAGAC-5' | (SEQ ID NO: 112) |
| LDHA-1359 Target: | 5'-TGCATGTTGTCCTTTTTATCTGATCTG-3' | (SEQ ID NO: 184) |
| | 5'-AUGUUGUCCUUUUUAUCUGAUCUGU-3' | (SEQ ID NO: 257) |
| | 3'-CGUACAACAGGAAAAAUAGACUAGACA-5' | (SEQ ID NO: 113) |
| LDHA-1360 Target: | 5'-GCATGTTGTCCTTTTTATCTGATCTGT-3' | (SEQ ID NO: 185) |
| | 5'-UGUUGUCCUUUUUAUCUGAUCUGUG-3' | (SEQ ID NO: 258) |
| | 3'-GUACAACAGGAAAAAUAGACUAGACAC-5' | (SEQ ID NO: 114) |
| LDHA-1361 Target: | 5'-CATGTTGTCCTTTTTATCTGATCTGTG-3' | (SEQ ID NO: 186) |
| | 5'-GUUGUCCUUUUUAUCUGAUCUGUGA-3' | (SEQ ID NO: 259) |
| | 3'-UACAACAGGAAAAAUAGACUAGACACU-5' | (SEQ ID NO: 115) |
| LDHA-1362 Target: | 5'-ATGTTGTCCTTTTTATCTGATCTGTGA-3' | (SEQ ID NO: 187) |
| | 5'-UUGUCCUUUUUAUCUGAUCUGUGAU-3' | (SEQ ID NO: 260) |
| | 3'-ACAACAGGAAAAAUAGACUAGACACUA-5' | (SEQ ID NO: 116) |
| LDHA-1363 Target: | 5'-TGTTGTCCTTTTTATCTGATCTGTGAT-3' | (SEQ ID NO: 188) |

TABLE 3-continued

Selected Human Anti-Lactate Dehydrogenase DsiRNAs, Unmodified Duplexes (Asymmetrics)

| | | |
|---|---|---|
| | 5'-GUCCUUUUAUCUGAUCUGUGAUUA-3' | (SEQ ID NO: 261) |
| | 3'-AACAGGAAAAAUAGACUAGACACUAAU-5' | (SEQ ID NO: 117) |
| LDHA-1365 Target: | 5'-TTGTCCTTTTTATCTGATCTGTGATTA-3' | (SEQ ID NO: 189) |
| | 5'-UCCUUUUUAUCUGAUCUGUGAUUAA-3' | (SEQ ID NO: 262) |
| | 3'-ACAGGAAAAAUAGACUAGACACUAAUU-5' | (SEQ ID NO: 118) |
| LDHA-1366 Target: | 5'-TGTCCTTTTTATCTGATCTGTGATTAA-3' | (SEQ ID NO: 190) |
| | 5'-CCUUUUUAUCUGAUCUGUGAUUAAA-3' | (SEQ ID NO: 263) |
| | 3'-CAGGAAAAAUAGACUAGACACUAAUUU-5' | (SEQ ID NO: 119) |
| LDHA-1367 Target: | 5'-GTCCTTTTTATCTGATCTGTGATTAAA-3' | (SEQ ID NO: 191) |
| | 5'-CUUUUUAUCUGAUCUGUGAUUAAAG-3' | (SEQ ID NO: 264) |
| | 3'-AGGAAAAAUAGACUAGACACUAAUUUC-5' | (SEQ ID NO: 120) |
| LDHA-1368 Target: | 5'-TCCTTTTTATCTGATCTGTGATTAAAG-3' | (SEQ ID NO: 192) |
| | 5'-UUUUAUCUGAUCUGUGAUUAAAGCA-3' | (SEQ ID NO: 265) |
| | 3'-GAAAAAUAGACUAGACACUAAUUUCGU-5' | (SEQ ID NO: 121) |
| LDHA-1370 Target: | 5'-CTTTTTATCTGATCTGTGATTAAAGCA-3' | (SEQ ID NO: 193) |
| | 5'-UUUAUCUGAUCUGUGAUUAAAGCAG-3' | (SEQ ID NO: 266) |
| | 3'-AAAAAUAGACUAGACACUAAUUUCGUC-5' | (SEQ ID NO: 122) |
| LDHA-1371 Target: | 5'-TTTTTATCTGATCTGTGATTAAAGCAG-3' | (SEQ ID NO: 194) |
| | 5'-UUAUCUGAUCUGUGAUUAAAGCAGU-3' | (SEQ ID NO: 267) |
| | 3'-AAAAUAGACUAGACACUAAUUUCGUCA-5' | (SEQ ID NO: 123) |
| LDHA-1372 Target: | 5'-TTTTATCTGATCTGTGATTAAAGCAGT-3' | (SEQ ID NO: 195) |
| | 5'-CAGUAAUAUUUUAAGAUGGACUGGG-3' | (SEQ ID NO: 268) |
| | 3'-UCGUCAUUAUAAAAUUCUACCUGACCC-5' | (SEQ ID NO: 124) |
| LDHA-1393 Target: | 5'-AGCAGTAATATTTTAAGATGGACTGGG-3' | (SEQ ID NO: 196) |
| | 5'-AACUCCUGAAGUUAGAAAUAAGAAU-3' | (SEQ ID NO: 269) |
| | 3'-AGUUGAGGACUUCAAUCUUUAUUCUUA-5' | (SEQ ID NO: 125) |
| LDHA-1427 Target: | 5'-TCAACTCCTGAAGTTAGAAATAAGAAT-3' | (SEQ ID NO: 197) |
| | 5'-ACUCCUGAAGUUAGAAAUAAGAAUG-3' | (SEQ ID NO: 270) |
| | 3'-GUUGAGGACUUCAAUCUUUAUUCUUAC-5' | (SEQ ID NO: 126) |
| LDHA-1428 Target: | 5'-CAACTCCTGAAGTTAGAAATAAGAATG-3' | (SEQ ID NO: 198) |
| | 5'-AACUGGUUAGUGUGAAAUAGUUCUG-3' | (SEQ ID NO: 271) |
| | 3'-AGUUGACCAAUCACACUUUAUCAAGAC-5' | (SEQ ID NO: 127) |
| LDHA-1512 Target: | 5'-TCAACTGGTTAGTGTGAAATAGTTCTG-3' | (SEQ ID NO: 199) |
| | 5'-ACUGGUUAGUGUGAAAUAGUUCUGC-3' | (SEQ ID NO: 272) |
| | 3'-GUUGACCAAUCACACUUUAUCAAGACG-5' | (SEQ ID NO: 128) |
| LDHA-1513 Target: | 5'-CAACTGGTTAGTGTGAAATAGTTCTGC-3' | (SEQ ID NO: 200) |
| | 5'-CUGGUUAGUGUGAAAUAGUUCUGCC-3' | (SEQ ID NO: 273) |
| | 3'-UUGACCAAUCACACUUUAUCAAGACGG-5' | (SEQ ID NO: 129) |
| LDHA-1514 Target: | 5'-AACTGGTTAGTGTGAAATAGTTCTGCC-3' | (SEQ ID NO: 201) |
| | 5'-GGUUAGUGUGAAAUAGUUCUGCCAC-3' | (SEQ ID NO: 274) |
| | 3'-GACCAAUCACACUUUAUCAAGACGGUG-5' | (SEQ ID NO: 130) |
| LDHA-1516 Target: | 5'-CTGGTTAGTGTGAAATAGTTCTGCCAC-3' | (SEQ ID NO: 202) |
| | 5'-AUCCAGUGUAUAAAUCCAAUAUCAU-3' | (SEQ ID NO: 275) |
| | 3'-CCUAGGUCACAUAUUUAGGUUAUAGUA-5' | (SEQ ID NO: 131) |
| LDHA-1684 Target: | 5'-GGATCCAGTGTATAAATCCAATATCAT-3' | (SEQ ID NO: 203) |
| | 5'-AGUGUAUAAAUCCAAUAUCAUGUCU-3' | (SEQ ID NO: 276) |
| | 3'-GGUCACAUAUUUAGGUUAUAGUACAGA-5' | (SEQ ID NO: 132) |
| LDHA-1688 Target: | 5'-CCAGTGTATAAATCCAATATCATGTCT-3' | (SEQ ID NO: 204) |
| | 5'-CUUAUUUUGUGAACUAUAUCAGUAG-3' | (SEQ ID NO: 277) |
| | 3'-UAGAAUAAAACACUUGAUAUAGUCAUC-5' | (SEQ ID NO: 133) |
| LDHA-1736 Target: | 5'-ATCTTATTTTGTGAACTATATCAGTAG-3' | (SEQ ID NO: 205) |
| | 5'-UAUAUCAGUAGUGUACAUUACCAUA-3' | (SEQ ID NO: 278) |
| | 3'-UGAUAUAGUCAUCACAUGUAAUGGUAU-5' | (SEQ ID NO: 134) |
| LDHA-1750 Target: | 5'-ACTATATCAGTAGTGTACATTACCATA-3' | (SEQ ID NO: 206) |
| | 5'-AUCAGUAGUGUACAUUACCAUAUAA-3' | (SEQ ID NO: 279) |
| | 3'-UAUAGUCAUCACAUGUAAUGGUAUAUU-5' | (SEQ ID NO: 135) |
| LDHA-1753 Target: | 5'-ATATCAGTAGTGTACATTACCATATAA-3' | (SEQ ID NO: 207) |

TABLE 3-continued

Selected Human Anti-Lactate Dehydrogenase DsiRNAs, Unmodified Duplexes (Asymmetrics)

|  |  |  |
|---|---|---|
| LDHA-1754 Target: | 5'-UCAGUAGUGUACAUUACCAUAUAAU-3'<br>3'-AUAGUCAUCACAUGUAAUGGUAUAUUA-5'<br>5'-TATCAGTAGTGTACATTACCATATAAT-3' | (SEQ ID NO: 280)<br>(SEQ ID NO: 136)<br>(SEQ ID NO: 208) |
| LDHA-1805 Target: | 5'-CAACCAACUAUCCAAGUGUUAUACC-3'<br>3'-ACGUUGGUUGAUAGGUUCACAAUAUGG-5'<br>5'-TGCAACCAACTATCCAAGTGTTATACC-3' | (SEQ ID NO: 281)<br>(SEQ ID NO: 137)<br>(SEQ ID NO: 209) |
| LDHA-1806 Target: | 5'-AACCAACUAUCCAAGUGUUAUACCA-3'<br>3'-CGUUGGUUGAUAGGUUCACAAUAUGGU-5'<br>5'-GCAACCAACTATCCAAGTGTTATACCA-3' | (SEQ ID NO: 282)<br>(SEQ ID NO: 138)<br>(SEQ ID NO: 210) |
| LDHA-1807 Target: | 5'-ACCAACUAUCCAAGUGUUAUACCAA-3'<br>3'-GUUGGUUGAUAGGUUCACAAUAUGGUU-5'<br>5'-CAACCAACTATCCAAGTGTTATACCAA-3' | (SEQ ID NO: 283)<br>(SEQ ID NO: 139)<br>(SEQ ID NO: 211) |
| LDHA-1808 Target: | 5'-CCAACUAUCCAAGUGUUAUACCAAC-3'<br>3'-UUGGUUGAUAGGUUCACAAUAUGGUUG-5'<br>5'-AACCAACTATCCAAGTGTTATACCAAC-3' | (SEQ ID NO: 284)<br>(SEQ ID NO: 140)<br>(SEQ ID NO: 212) |
| LDHA-1811 Target: | 5'-ACUAUCCAAGUGUUAUACCAACUAA-3'<br>3'-GUUGAUAGGUUCACAAUAUGGUUGAUU-5'<br>5'-CAACTATCCAAGTGTTATACCAACTAA-3' | (SEQ ID NO: 285)<br>(SEQ ID NO: 141)<br>(SEQ ID NO: 213) |
| LDHA-1812 Target: | 5'-CUAUCCAAGUGUUAUACCAACUAAA-3'<br>3'-UUGAUAGGUUCACAAUAUGGUUGAUUU-5'<br>5'-AACTATCCAAGTGTTATACCAACTAAA-3' | (SEQ ID NO: 286)<br>(SEQ ID NO: 142)<br>(SEQ ID NO: 214) |
| LDHA-1815 Target: | 5'-UCCAAGUGUUAUACCAACUAAAACC-3'<br>3'-AUAGGUUCACAAUAUGGUUGAUUUUGG-5'<br>5'-TATCCAAGTGTTATACCAACTAAAACC-3' | (SEQ ID NO: 287)<br>(SEQ ID NO: 143)<br>(SEQ ID NO: 215) |
| LDHA-1816 Target: | 5'-CCAAGUGUUAUACCAACUAAAACCC-3'<br>3'-UAGGUUCACAAUAUGGUUGAUUUUGGG-5'<br>5'-ATCCAAGTGTTATACCAACTAAAACCC-3' | (SEQ ID NO: 288)<br>(SEQ ID NO: 144)<br>(SEQ ID NO: 216) |

TABLE 4

DsiRNA Target Sequences (21mers) in Human Lactate Dehydrogenase mRNA

| | | |
|---|---|---|
| LDHA-355 21 nt Target: | 5'-CCAGAAUAAGAUUACAGUUGU-3' | (SEQ ID NO: 289) |
| LDHA-356 21 nt Target: | 5'-CAGAAUAAGAUUACAGUUGUU-3' | (SEQ ID NO: 290) |
| LDHA-360 21 nt Target: | 5'-AUAAGAUUACAGUUGUUGGGG-3' | (SEQ ID NO: 291) |
| LDHA-361 21 nt Target: | 5'-UAAGAUUACAGUUGUUGGGGU-3' | (SEQ ID NO: 292) |
| LDHA-362 21 nt Target: | 5'-AAGAUUACAGUUGUUGGGGUU-3' | (SEQ ID NO: 293) |
| LDHA-363 21 nt Target: | 5'-AGAUUACAGUUGUUGGGGUUG-3' | (SEQ ID NO: 294) |
| LDHA-364 21 nt Target: | 5'-GAUUACAGUUGUUGGGGUUGG-3' | (SEQ ID NO: 295) |
| LDHA-365 21 nt Target: | 5'-AUUACAGUUGUUGGGGUUGGU-3' | (SEQ ID NO: 296) |
| LDHA-366 21 nt Target: | 5'-UUACAGUUGUUGGGGUUGGUG-3' | (SEQ ID NO: 297) |
| LDHA-367 21 nt Target: | 5'-UACAGUUGUUGGGGUUGGUGC-3' | (SEQ ID NO: 298) |
| LDHA-369 21 nt Target: | 5'-CAGUUGUUGGGGUUGGUGCUG-3' | (SEQ ID NO: 299) |
| LDHA-370 21 nt Target: | 5'-AGUUGUUGGGGUUGGUGCUGU-3' | (SEQ ID NO: 300) |
| LDHA-397 21 nt Target: | 5'-GGCCUGUGCCAUCAGUAUCUU-3' | (SEQ ID NO: 301) |
| LDHA-398 21 nt Target: | 5'-GCCUGUGCCAUCAGUAUCUUA-3' | (SEQ ID NO: 302) |
| LDHA-399 21 nt Target: | 5'-CCUGUGCCAUCAGUAUCUUAA-3' | (SEQ ID NO: 303) |
| LDHA-400 21 nt Target: | 5'-CUGUGCCAUCAGUAUCUUAAU-3' | (SEQ ID NO: 304) |
| LDHA-401 21 nt Target: | 5'-UGUGCCAUCAGUAUCUUAAUG-3' | (SEQ ID NO: 305) |

TABLE 4-continued

DsiRNA Target Sequences (21mers) in Human Lactate Dehydrogenase mRNA

| | | |
|---|---|---|
| LDHA-402 21 nt Target: | 5'-GUGCCAUCAGUAUCUUAAUGA-3' | (SEQ ID NO: 306) |
| LDHA-403 21 nt Target: | 5'-UGCCAUCAGUAUCUUAAUGAA-3' | (SEQ ID NO: 307) |
| LDHA-404 21 nt Target: | 5'-GCCAUCAGUAUCUUAAUGAAG-3' | (SEQ ID NO: 308) |
| LDHA-714 21 nt Target: | 5'-CAGUGGAUAUCUUGACCUACG-3' | (SEQ ID NO: 309) |
| LDHA-717 21 nt Target: | 5'-UGGAUAUCUUGACCUACGUGG-3' | (SEQ ID NO: 310) |
| LDHA-718 21 nt Target: | 5'-GGAUAUCUUGACCUACGUGGC-3' | (SEQ ID NO: 311) |
| LDHA-719 21 nt Target: | 5'-GAUAUCUUGACCUACGUGGCU-3' | (SEQ ID NO: 312) |
| LDHA-720 21 nt Target: | 5'-AUAUCUUGACCUACGUGGCUU-3' | (SEQ ID NO: 313) |
| LDHA-722 21 nt Target: | 5'-AUCUUGACCUACGUGGCUUGG-3' | (SEQ ID NO: 314) |
| LDHA-723 21 nt Target: | 5'-UCUUGACCUACGUGGCUUGGA-3' | (SEQ ID NO: 315) |
| LDHA-724 21 nt Target: | 5'-CUUGACCUACGUGGCUUGGAA-3' | (SEQ ID NO: 316) |
| LDHA-739 21 nt Target: | 5'-UUGGAAGAUAAGUGGUUUUCC-3' | (SEQ ID NO: 317) |
| LDHA-740 21 nt Target: | 5'-UGGAAGAUAAGUGGUUUUCCC-3' | (SEQ ID NO: 318) |
| LDHA-891 21 nt Target: | 5'-UGCCUGUAUGGAGUGGAAUGA-3' | (SEQ ID NO: 319) |
| LDHA-892 21 nt Target: | 5'-GCCUGUAUGGAGUGGAAUGAA-3' | (SEQ ID NO: 320) |
| LDHA-907 21 nt Target: | 5'-AAUGAAUGUUGCUGGUGUCUC-3' | (SEQ ID NO: 321) |
| LDHA-952 21 nt Target: | 5'-AGGGACUGAUAAAGAUAAGGA-3' | (SEQ ID NO: 322) |
| LDHA-1286 21 nt Target: | 5'-CUGCAAUUUUAAAGUCUUCUG-3' | (SEQ ID NO: 323) |
| LDHA-1287 21 nt Target: | 5'-UGCAAUUUUAAAGUCUUCUGA-3' | (SEQ ID NO: 324) |
| LDHA-1292 21 nt Target: | 5'-UUUUAAAGUCUUCUGAUGUCA-3' | (SEQ ID NO: 325) |
| LDHA-1293 21 nt Target: | 5'-UUUAAAGUCUUCUGAUGUCAU-3' | (SEQ ID NO: 326) |
| LDHA-1294 21 nt Target: | 5'-UUAAAGUCUUCUGAUGUCAUA-3' | (SEQ ID NO: 327) |
| LDHA-1359 21 nt Target: | 5'-UGCAUGUUGUCCUUUUUAUCU-3' | (SEQ ID NO: 328) |
| LDHA-1360 21 nt Target: | 5'-GCAUGUUGUCCUUUUUAUCUG-3' | (SEQ ID NO: 329) |
| LDHA-1361 21 nt Target: | 5'-CAUGUUGUCCUUUUUAUCUGA-3' | (SEQ ID NO: 330) |
| LDHA-1362 21 nt Target: | 5'-AUGUUGUCCUUUUUAUCUGAU-3' | (SEQ ID NO: 331) |
| LDHA-1363 21 nt Target: | 5'-UGUUGUCCUUUUUAUCUGAUC-3' | (SEQ ID NO: 332) |
| LDHA-1365 21 nt Target: | 5'-UUGUCCUUUUUAUCUGAUCUG-3' | (SEQ ID NO: 333) |
| LDHA-1366 21 nt Target: | 5'-UGUCCUUUUUAUCUGAUCUGU-3' | (SEQ ID NO: 334) |
| LDHA-1367 21 nt Target: | 5'-GUCCUUUUUAUCUGAUCUGUG-3' | (SEQ ID NO: 335) |
| LDHA-1368 21 nt Target: | 5'-UCCUUUUUAUCUGAUCUGUGA-3' | (SEQ ID NO: 336) |
| LDHA-1370 21 nt Target: | 5'-CUUUUUAUCUGAUCUGUGAUU-3' | (SEQ ID NO: 337) |
| LDHA-1371 21 nt Target: | 5'-UUUUUAUCUGAUCUGUGAUUA-3' | (SEQ ID NO: 338) |
| LDHA-1372 21 nt Target: | 5'-UUUUAUCUGAUCUGUGAUUAA-3' | (SEQ ID NO: 339) |
| LDHA-1393 21 nt Target: | 5'-AGCAGUAAUAUUUUAAGAUGG-3' | (SEQ ID NO: 340) |
| LDHA-1427 21 nt Target: | 5'-UCAACUCCUGAAGUUAGAAAU-3' | (SEQ ID NO: 341) |
| LDHA-1428 21 nt Target: | 5'-CAACUCCUGAAGUUAGAAAUA-3' | (SEQ ID NO: 342) |
| LDHA-1512 21 nt Target: | 5'-UCAACUGGUUAGUGUGAAAUA-3' | (SEQ ID NO: 343) |
| LDHA-1513 21 nt Target: | 5'-CAACUGGUUAGUGUGAAAUAG-3' | (SEQ ID NO: 344) |

TABLE 4-continued

| DsiRNA Target Sequences (21mers) in Human Lactate Dehydrogenase mRNA | | |
|---|---|---|
| LDHA-1514 21 nt Target: | 5'-AACUGGUUAGUGUGAAAUAGU-3' | (SEQ ID NO: 345) |
| LDHA-1516 21 nt Target: | 5'-CUGGUUAGUGUGAAAUAGUUC-3' | (SEQ ID NO: 346) |
| LDHA-1684 21 nt Target: | 5'-GGAUCCAGUGUAUAAAUCCAA-3' | (SEQ ID NO: 347) |
| LDHA-1688 21 nt Target: | 5'-CCAGUGUAUAAAUCCAAUAUC-3' | (SEQ ID NO: 348) |
| LDHA-1736 21 nt Target: | 5'-AUCUUAUUUGUGAACUAUAU-3' | (SEQ ID NO: 349) |
| LDHA-1750 21 nt Target: | 5'-ACUAUAUCAGUAGUGUACAUU-3' | (SEQ ID NO: 350) |
| LDHA-1753 21 nt Target: | 5'-AUAUCAGUAGUGUACAUUACC-3' | (SEQ ID NO: 351) |
| LDHA-1754 21 nt Target: | 5'-UAUCAGUAGUGUACAUUACCA-3' | (SEQ ID NO: 352) |
| LDHA-1805 21 nt Target: | 5'-UGCAACCAACUAUCCAAGUGU-3' | (SEQ ID NO: 353) |
| LDHA-1806 21 nt Target: | 5'-GCAACCAACUAUCCAAGUGUU-3' | (SEQ ID NO: 354) |
| LDHA-1807 21 nt Target: | 5'-CAACCAACUAUCCAAGUGUUA-3' | (SEQ ID NO: 355) |
| LDHA-1808 21 nt Target: | 5'-AACCAACUAUCCAAGUGUUAU-3' | (SEQ ID NO: 356) |
| LDHA-1811 21 nt Target: | 5'-CAACUAUCCAAGUGUUAUACC-3' | (SEQ ID NO: 357) |
| LDHA-1812 21 nt Target: | 5'-AACUAUCCAAGUGUUAUACCA-3' | (SEQ ID NO: 358) |
| LDHA-1815 21 nt Target: | 5'-UAUCCAAGUGUUAUACCAACU-3' | (SEQ ID NO: 359) |
| LDHA-1816 21 nt Target: | 5'-AUCCAAGUGUUAUACCAACUA-3' | (SEQ ID NO: 360) |

TABLE 5

| Selected Human Anti-Lactate Dehydrogenase "Blunt/Blunt" DsiRNAs | | |
|---|---|---|
| | 5'-CCAGAAUAAGAUUACAGUUGUUGGGGU-3' | (SEQ ID NO: 361) |
| | 3'-GGUCUUAUUCUAAUGUCAACAACCCCA-5' | (SEQ ID NO: 73) |
| LDHA-355 Target: | 5'-CCAGAATAAGATTACAGTTGTTGGGGT-3' | (SEQ ID NO: 145) |
| | 5'-CAGAAUAAGAUUACAGUUGUUGGGGUU-3' | (SEQ ID NO: 362) |
| | 3'-GUCUUAUUCUAAUGUCAACAACCCCAA-5' | (SEQ ID NO: 74) |
| LDHA-356 Target: | 5'-CAGAATAAGATTACAGTTGTTGGGGTT-3' | (SEQ ID NO: 146) |
| | 5'-AUAAGAUUACAGUUGUUGGGGUUGGUG-3' | (SEQ ID NO: 363) |
| | 3'-UAUUCUAAUGUCAACAACCCCAACCAC-5' | (SEQ ID NO: 75) |
| LDHA-360 Target: | 5'-ATAAGATTACAGTTGTTGGGGTTGGTG-3' | (SEQ ID NO: 147) |
| | 5'-UAAGAUUACAGUUGUUGGGGUUGGUGC-3' | (SEQ ID NO: 364) |
| | 3'-AUUCUAAUGUCAACAACCCCAACCACG-5' | (SEQ ID NO: 76) |
| LDHA-361 Target: | 5'-TAAGATTACAGTTGTTGGGGTTGGTGC-3' | (SEQ ID NO: 148) |
| | 5'-AAGAUUACAGUUGUUGGGGUUGGUGCU-3' | (SEQ ID NO: 365) |
| | 3'-UUCUAAUGUCAACAACCCCAACCACGA-5' | (SEQ ID NO: 77) |
| LDHA-362 Target: | 5'-AAGATTACAGTTGTTGGGGTTGGTGCT-3' | (SEQ ID NO: 149) |
| | 5'-AGAUUACAGUUGUUGGGGUUGGUGCUG-3' | (SEQ ID NO: 366) |
| | 3'-UCUAAUGUCAACAACCCCAACCACGAC-5' | (SEQ ID NO: 78) |
| LDHA-363 Target: | 5'-AGATTACAGTTGTTGGGGTTGGTGCTG-3' | (SEQ ID NO: 150) |
| | 5'-GAUUACAGUUGUUGGGGUUGGUGCUGU-3' | (SEQ ID NO: 367) |
| | 3'-CUAAUGUCAACAACCCCAACCACGACA-5' | (SEQ ID NO: 79) |
| LDHA-364 Target: | 5'-GATTACAGTTGTTGGGGTTGGTGCTGT-3' | (SEQ ID NO: 151) |
| | 5'-AUUACAGUUGUUGGGGUUGGUGCUGUU-3' | (SEQ ID NO: 368) |
| | 3'-UAAUGUCAACAACCCCAACCACGACAA-5' | (SEQ ID NO: 80) |
| LDHA-365 Target: | 5'-ATTACAGTTGTTGGGGTTGGTGCTGTT-3' | (SEQ ID NO: 152) |
| | 5'-UUACAGUUGUUGGGGUUGGUGCUGUUG-3' | (SEQ ID NO: 369) |
| | 3'-AAUGUCAACAACCCCAACCACGACAAC-5' | (SEQ ID NO: 81) |
| LDHA-366 Target: | 5'-TTACAGTTGTTGGGGTTGGTGCTGTTG-3' | (SEQ ID NO: 153) |
| | 5'-UACAGUUGUUGGGGUUGGUGCUGUUGG-3' | (SEQ ID NO: 370) |
| | 3'-AUGUCAACAACCCCAACCACGACAACC-5' | (SEQ ID NO: 82) |
| LDHA-367 Target: | 5'-TACAGTTGTTGGGGTTGGTGCTGTTGG-3' | (SEQ ID NO: 154) |

TABLE 5-continued

Selected Human Anti-Lactate Dehydrogenase "Blunt/Blunt" DsiRNAs

|  | | |
|---|---|---|
| | 5'-CAGUUGUUGGGGUUGGUGCUGUUGGCA-3' | (SEQ ID NO: 371) |
| | 3'-GUCAACAACCCCAACCACGACAACCGU-5' | (SEQ ID NO: 83) |
| LDHA-369 Target: | 5'-CAGTTGTTGGGGTTGGTGCTGTTGGCA-3' | (SEQ ID NO: 155) |
| | 5'-AGUUGUUGGGGUUGGUGCUGUUGGCAU-3' | (SEQ ID NO: 372) |
| | 3'-UCAACAACCCCAACCACGACAACCGUA-5' | (SEQ ID NO: 84) |
| LDHA-370 Target: | 5'-AGTTGTTGGGGTTGGTGCTGTTGGCAT-3' | (SEQ ID NO: 156) |
| | 5'-GGCCUGUGCCAUCAGUAUCUUAAUGAA-3' | (SEQ ID NO: 373) |
| | 3'-CCGGACACGGUAGUCAUAGAAUUACUU-5' | (SEQ ID NO: 85) |
| LDHA-397 Target: | 5'-GGCCTGTGCCATCAGTATCTTAATGAA-3' | (SEQ ID NO: 157) |
| | 5'-GCCUGUGCCAUCAGUAUCUUAAUGAAG-3' | (SEQ ID NO: 374) |
| | 3'-CGGACACGGUAGUCAUAGAAUUACUUC-5' | (SEQ ID NO: 86) |
| LDHA-398 Target: | 5'-GCCTGTGCCATCAGTATCTTAATGAAG-3' | (SEQ ID NO: 158) |
| | 5'-CCUGUGCCAUCAGUAUCUUAAUGAAGG-3' | (SEQ ID NO: 375) |
| | 3'-GGACACGGUAGUCAUAGAAUUACUUCC-5' | (SEQ ID NO: 87) |
| LDHA-399 Target: | 5'-CCTGTGCCATCAGTATCTTAATGAAGG-3' | (SEQ ID NO: 159) |
| | 5'-CUGUGCCAUCAGUAUCUUAAUGAAGGA-3' | (SEQ ID NO: 376) |
| | 3'-GACACGGUAGUCAUAGAAUUACUUCCU-5' | (SEQ ID NO: 88) |
| LDHA-400 Target: | 5'-CTGTGCCATCAGTATCTTAATGAAGGA-3' | (SEQ ID NO: 160) |
| | 5'-UGUGCCAUCAGUAUCUUAAUGAAGGAC-3' | (SEQ ID NO: 377) |
| | 3'-ACACGGUAGUCAUAGAAUUACUUCCUG-5' | (SEQ ID NO: 89) |
| LDHA-401 Target: | 5'-TGTGCCATCAGTATCTTAATGAAGGAC-3' | (SEQ ID NO: 161) |
| | 5'-GUGCCAUCAGUAUCUUAAUGAAGGACU-3' | (SEQ ID NO: 378) |
| | 3'-CACGGUAGUCAUAGAAUUACUUCCUGA-5' | (SEQ ID NO: 90) |
| LDHA-402 Target: | 5'-GTGCCATCAGTATCTTAATGAAGGACT-3' | (SEQ ID NO: 162) |
| | 5'-UGCCAUCAGUAUCUUAAUGAAGGACUU-3' | (SEQ ID NO: 379) |
| | 3'-ACGGUAGUCAUAGAAUUACUUCCUGAA-5' | (SEQ ID NO: 91) |
| LDHA-403 Target: | 5'-TGCCATCAGTATCTTAATGAAGGACTT-3' | (SEQ ID NO: 163) |
| | 5'-GCCAUCAGUAUCUUAAUGAAGGACUUG-3' | (SEQ ID NO: 380) |
| | 3'-CGGUAGUCAUAGAAUUACUUCCUGAAC-5' | (SEQ ID NO: 92) |
| LDHA-404 Target: | 5'-GCCATCAGTATCTTAATGAAGGACTTG-3' | (SEQ ID NO: 164) |
| | 5'-CAGUGGAUAUCUUGACCUACGUGGCUU-3' | (SEQ ID NO: 381) |
| | 3'-GUCACCUAUAGAACUGGAUGCACCGAA-5' | (SEQ ID NO: 93) |
| LDHA-714 Target: | 5'-CAGTGGATATCTTGACCTACGTGGCTT-3' | (SEQ ID NO: 165) |
| | 5'-UGGAUAUCUUGACCUACGUGGCUUGGA-3' | (SEQ ID NO: 382) |
| | 3'-ACCUAUAGAACUGGAUGCACCGAACCU-5' | (SEQ ID NO: 94) |
| LDHA-717 Target: | 5'-TGGATATCTTGACCTACGTGGCTTGGA-3' | (SEQ ID NO: 166) |
| | 5'-GGAUAUCUUGACCUACGUGGCUUGGAA-3' | (SEQ ID NO: 383) |
| | 3'-CCUAUAGAACUGGAUGCACCGAACCUU-5' | (SEQ ID NO: 95) |
| LDHA-718 Target: | 5'-GGATATCTTGACCTACGTGGCTTGGAA-3' | (SEQ ID NO: 167) |
| | 5'-GAUAUCUUGACCUACGUGGCUUGGAAG-3' | (SEQ ID NO: 384) |
| | 3'-CUAUAGAACUGGAUGCACCGAACCUUC-5' | (SEQ ID NO: 96) |
| LDHA-719 Target: | 5'-GATATCTTGACCTACGTGGCTTGGAAG-3' | (SEQ ID NO: 168) |
| | 5'-AUAUCUUGACCUACGUGGCUUGGAAGA-3' | (SEQ ID NO: 385) |
| | 3'-UAUAGAACUGGAUGCACCGAACCUUCU-5' | (SEQ ID NO: 97) |
| LDHA-720 Target: | 5'-ATATCTTGACCTACGTGGCTTGGAAGA-3' | (SEQ ID NO: 169) |
| | 5'-AUCUUGACCUACGUGGCUUGGAAGAUA-3' | (SEQ ID NO: 386) |
| | 3'-UAGAACUGGAUGCACCGAACCUUCUAU-5' | (SEQ ID NO: 98) |
| LDHA-722 Target: | 5'-ATCTTGACCTACGTGGCTTGGAAGATA-3' | (SEQ ID NO: 170) |
| | 5'-UCUUGACCUACGUGGCUUGGAAGAUAA-3' | (SEQ ID NO: 387) |
| | 3'-AGAACUGGAUGCACCGAACCUUCUAUU-5' | (SEQ ID NO: 99) |
| LDHA-723 Target: | 5'-TCTTGACCTACGTGGCTTGGAAGATAA-3' | (SEQ ID NO: 171) |
| | 5'-CUUGACCUACGUGGCUUGGAAGAUAAG-3' | (SEQ ID NO: 388) |
| | 3'-GAACUGGAUGCACCGAACCUUCUAUUC-5' | (SEQ ID NO: 100) |
| LDHA-724 Target: | 5'-CTTGACCTACGTGGCTTGGAAGATAAG-3' | (SEQ ID NO: 172) |
| | 5'-UUGGAAGAUAAGUGGUUUUCCCAAAAA-3' | (SEQ ID NO: 389) |
| | 3'-AACCUUCUAUUCACCAAAAGGGUUUUU-5' | (SEQ ID NO: 101) |
| LDHA-739 Target: | 5'-TTGGAAGATAAGTGGTTTTCCCAAAAA-3' | (SEQ ID NO: 173) |

TABLE 5-continued

Selected Human Anti-Lactate Dehydrogenase "Blunt/Blunt" DsiRNAs

|  |  |  |
|---|---|---|
| LDHA-740 Target: | 5'-UGGAAGAUAAGUGGUUUUCCCAAAAAC-3'<br>3'-ACCUUCUAUUCACCAAAAGGGUUUUUG-5'<br>5'-TGGAAGATAAGTGGTTTTCCCAAAAAC-3' | (SEQ ID NO: 390)<br>(SEQ ID NO: 102)<br>(SEQ ID NO: 174) |
| LDHA-891 Target: | 5'-UGCCUGUAUGGAGUGGAAUGAAUGUUG-3'<br>3'-ACGGACAUACCUCACCUUACUUACAAC-5'<br>5'-TGCCTGTATGGAGTGGAATGAATGTTG-3' | (SEQ ID NO: 391)<br>(SEQ ID NO: 103)<br>(SEQ ID NO: 175) |
| LDHA-892 Target: | 5'-GCCUGUAUGGAGUGGAAUGAAUGUUGC-3'<br>3'-CGGACAUACCUCACCUUACUUACAACG-5'<br>5'-GCCTGTATGGAGTGGAATGAATGTTGC-3' | (SEQ ID NO: 392)<br>(SEQ ID NO: 104)<br>(SEQ ID NO: 176) |
| LDHA-907 Target: | 5'-AAUGAAUGUUGCUGGUGUCUCUCUGAA-3'<br>3'-UUACUUACAACGACCACAGAGAGACUU-5'<br>5'-AATGAATGTTGCTGGTGTCTCTCTGAA-3' | (SEQ ID NO: 393)<br>(SEQ ID NO: 105)<br>(SEQ ID NO: 177) |
| LDHA-952 Target: | 5'-AGGGACUGAUAAAGAUAAGGAACAGUG-3'<br>3'-UCCCUGACUAUUUCUAUUCCUUGUCAC-5'<br>5'-AGGGACTGATAAAGATAAGGAACAGTG-3' | (SEQ ID NO: 394)<br>(SEQ ID NO: 106)<br>(SEQ ID NO: 178) |
| LDHA-1286 Target: | 5'-CUGCAAUUUUAAAGUCUUCUGAUGUCA-3'<br>3'-GACGUUAAAAUUUCAGAAGACUACAGU-5'<br>5'-CTGCAATTTTAAAGTCTTCTGATGTCA-3' | (SEQ ID NO: 395)<br>(SEQ ID NO: 107)<br>(SEQ ID NO: 179) |
| LDHA-1287 Target: | 5'-UGCAAUUUUAAAGUCUUCUGAUGUCAU-3'<br>3'-ACGUUAAAAUUUCAGAAGACUACAGUA-5'<br>5'-TGCAATTTTAAAGTCTTCTGATGTCAT-3' | (SEQ ID NO: 396)<br>(SEQ ID NO: 108)<br>(SEQ ID NO: 180) |
| LDHA-1292 Target: | 5'-UUUUAAAGUCUUCUGAUGUCAUAUCAU-3'<br>3'-AAAAUUUCAGAAGACUACAGUAUAGUA-5'<br>5'-TTTTAAAGTCTTCTGATGTCATATCAT-3' | (SEQ ID NO: 397)<br>(SEQ ID NO: 109)<br>(SEQ ID NO: 181) |
| LDHA-1293 Target: | 5'-UUUAAAGUCUUCUGAUGUCAUAUCAUU-3'<br>3'-AAAUUUCAGAAGACUACAGUAUAGUAA-5'<br>5'-TTTAAAGTCTTCTGATGTCATATCATT-3' | (SEQ ID NO: 398)<br>(SEQ ID NO: 110)<br>(SEQ ID NO: 182) |
| LDHA-1294 Target: | 5'-UUAAAGUCUUCUGAUGUCAUAUCAUUU-3'<br>3'-AAUUUCAGAAGACUACAGUAUAGUAAA-5'<br>5'-TTAAAGTCTTCTGATGTCATATCATTT-3' | (SEQ ID NO: 399)<br>(SEQ ID NO: 111)<br>(SEQ ID NO: 183) |
| LDHA-1359 Target: | 5'-UGCAUGUUGUCCUUUUUAUCUGAUCUG-3'<br>3'-ACGUACAACAGGAAAAAUAGACUAGAC-5'<br>5'-TGCATGTTGTCCTTTTTATCTGATCTG-3' | (SEQ ID NO: 400)<br>(SEQ ID NO: 112)<br>(SEQ ID NO: 184) |
| LDHA-1360 Target: | 5'-GCAUGUUGUCCUUUUUAUCUGAUCUGU-3'<br>3'-CGUACAACAGGAAAAAUAGACUAGACA-5'<br>5'-GCATGTTGTCCTTTTTATCTGATCTGT-3' | (SEQ ID NO: 401)<br>(SEQ ID NO: 113)<br>(SEQ ID NO: 185) |
| LDHA-1361 Target: | 5'-CAUGUUGUCCUUUUUAUCUGAUCUGUG-3'<br>3'-GUACAACAGGAAAAAUAGACUAGACAC-5'<br>5'-CATGTTGTCCTTTTTATCTGATCTGTG-3' | (SEQ ID NO: 402)<br>(SEQ ID NO: 114)<br>(SEQ ID NO: 186) |
| LDHA-1362 Target: | 5'-AUGUUGUCCUUUUUAUCUGAUCUGUGA-3'<br>3'-UACAACAGGAAAAAUAGACUAGACACU-5'<br>5'-ATGTTGTCCTTTTTATCTGATCTGTGA-3' | (SEQ ID NO: 403)<br>(SEQ ID NO: 115)<br>(SEQ ID NO: 187) |
| LDHA-1363 Target: | 5'-UGUUGUCCUUUUUAUCUGAUCUGUGAU-3'<br>3'-ACAACAGGAAAAAUAGACUAGACACUA-5'<br>5'-TGTTGTCCTTTTTATCTGATCTGTGAT-3' | (SEQ ID NO: 404)<br>(SEQ ID NO: 116)<br>(SEQ ID NO: 188) |
| LDHA-1365 Target: | 5'-UUGUCCUUUUUAUCUGAUCUGUGAUUA-3'<br>3'-AACAGGAAAAAUAGACUAGACACUAAU-5'<br>5'-TTGTCCTTTTTATCTGATCTGTGATTA-3' | (SEQ ID NO: 405)<br>(SEQ ID NO: 117)<br>(SEQ ID NO: 189) |
| LDHA-1366 Target: | 5'-UGUCCUUUUUAUCUGAUCUGUGAUUAA-3'<br>3'-ACAGGAAAAAUAGACUAGACACUAAUU-5'<br>5'-TGTCCTTTTTATCTGATCTGTGATTAA-3' | (SEQ ID NO: 406)<br>(SEQ ID NO: 118)<br>(SEQ ID NO: 190) |
| LDHA-1367 Target: | 5'-GUCCUUUUUAUCUGAUCUGUGAUUAAA-3'<br>3'-CAGGAAAAAUAGACUAGACACUAAUUU-5'<br>5'-GTCCTTTTTATCTGATCTGTGATTAAA-3' | (SEQ ID NO: 407)<br>(SEQ ID NO: 119)<br>(SEQ ID NO: 191) |
| LDHA-1368 Target: | 5'-UCCUUUUUAUCUGAUCUGUGAUUAAAG-3'<br>3'-AGGAAAAAUAGACUAGACACUAAUUUC-5'<br>5'-TCCTTTTTATCTGATCTGTGATTAAAG-3' | (SEQ ID NO: 408)<br>(SEQ ID NO: 120)<br>(SEQ ID NO: 192) |

TABLE 5-continued

Selected Human Anti-Lactate Dehydrogenase "Blunt/Blunt" DsiRNAs

```
                 5'-CUUUUUAUCUGAUCUGUGAUUAAAGCA-3'    (SEQ ID NO: 409)
                 3'-GAAAAAUAGACUAGACACUAAUUUCGU-5'    (SEQ ID NO: 121)
LDHA-1370 Target: 5'-CTTTTTATCTGATCTGTGATTAAAGCA-3'   (SEQ ID NO: 193)

5'-UUUUUAUCUGAUCUGUGAUUAAAGCAG-3'    (SEQ ID NO: 410)
                 3'-AAAAAUAGACUAGACACUAAUUUCGUC-5'    (SEQ ID NO: 122)
LDHA-1371 Target: 5'-TTTTTATCTGATCTGTGATTAAAGCAG-3'   (SEQ ID NO: 194)

5'-UUUUAUCUGAUCUGUGAUUAAAGCAGU-3'    (SEQ ID NO: 411)
                 3'-AAAAUAGACUAGACACUAAUUUCGUCA-5'    (SEQ ID NO: 123)
LDHA-1372 Target: 5'-TTTTATCTGATCTGTGATTAAAGCAGT-3'   (SEQ ID NO: 195)

5'-AGCAGUAAUAUUUUAAGAUGGACUGGG-3'    (SEQ ID NO: 412)
                 3'-UCGUCAUUAUAAAAUUCUACCUGACCC-5'    (SEQ ID NO: 124)
LDHA-1393 Target: 5'-AGCAGTAATATTTTAAGATGGACTGGG-3'   (SEQ ID NO: 196)

5'-UCAACUCCUGAAGUUAGAAAUAAGAAU-3'    (SEQ ID NO: 413)
                 3'-AGUUGAGGACUUCAAUCUUUAUUCUUA-5'    (SEQ ID NO: 125)
LDHA-1427 Target: 5'-TCAACTCCTGAAGTTAGAAATAAGAAT-3'   (SEQ ID NO: 197)

5'-CAACUCCUGAAGUUAGAAAUAAGAAUG-3'    (SEQ ID NO: 414)
                 3'-GUUGAGGACUUCAAUCUUUAUUCUUAC-5'    (SEQ ID NO: 126)
LDHA-1428 Target: 5'-CAACTCCTGAAGTTAGAAATAAGAATG-3'   (SEQ ID NO: 198)

5'-UCAACUGGUUAGUGUGAAAUAGUUCUG-3'    (SEQ ID NO: 415)
                 3'-AGUUGACCAAUCACACUUUAUCAAGAC-5'    (SEQ ID NO: 127)
LDHA-1512 Target: 5'-TCAACTGGTTAGTGTGAAATAGTTCTG-3'   (SEQ ID NO: 199)

5'-CAACUGGUUAGUGUGAAAUAGUUCUGC-3'    (SEQ ID NO: 416)
                 3'-GUUGACCAAUCACACUUUAUCAAGACG-5'    (SEQ ID NO: 128)
LDHA-1513 Target: 5'-CAACTGGTTAGTGTGAAATAGTTCTGC-3'   (SEQ ID NO: 200)

5'-AACUGGUUAGUGUGAAAUAGUUCUGCC-3'    (SEQ ID NO: 417)
                 3'-UUGACCAAUCACACUUUAUCAAGACGG-5'    (SEQ ID NO: 129)
LDHA-1514 Target: 5'-AACTGGTTAGTGTGAAATAGTTCTGCC-3'   (SEQ ID NO: 201)

5'-CUGGUUAGUGUGAAAUAGUUCUGCCAC-3'    (SEQ ID NO: 418)
                 3'-GACCAAUCACACUUUAUCAAGACGGUG-5'    (SEQ ID NO: 130)
LDHA-1516 Target: 5'-CTGGTTAGTGTGAAATAGTTCTGCCAC-3'   (SEQ ID NO: 202)

5'-GGAUCCAGUGUAUAAAUCCAAUAUCAU-3'    (SEQ ID NO: 419)
                 3'-CCUAGGUCACAUAUUUAGGUUAUAGUA-5'    (SEQ ID NO: 131)
LDHA-1684 Target: 5'-GGATCCAGTGTATAAATCCAATATCAT-3'   (SEQ ID NO: 203)

5'-CCAGUGUAUAAAUCCAAUAUCAUGUCU-3'    (SEQ ID NO: 420)
                 3'-GGUCACAUAUUUAGGUUAUAGUACAGA-5'    (SEQ ID NO: 132)
LDHA-1688 Target: 5'-CCAGTGTATAAATCCAATATCATGTCT-3'   (SEQ ID NO: 204)

5'-AUCUUAUUUUGUGAACUAUAUCAGUAG-3'    (SEQ ID NO: 421)
                 3'-UAGAAUAAAACACUUGAUAUAGUCAUC-5'    (SEQ ID NO: 133)
LDHA-1736 Target: 5'-ATCTTATTTTGTGAACTATATCAGTAG-3'   (SEQ ID NO: 205)

5'-ACUAUAUCAGUAGUGUACAUUACCAUA-3'    (SEQ ID NO: 422)
                 3'-UGAUAUAGUCAUCACAUGUAAUGGUAU-5'    (SEQ ID NO: 134)
LDHA-1750 Target: 5'-ACTATATCAGTAGTGTACATTACCATA-3'   (SEQ ID NO: 206)

5'-AUAUCAGUAGUGUACAUUACCAUAUAA-3'    (SEQ ID NO: 423)
                 3'-UAUAGUCAUCACAUGUAAUGGUAUAUU-5'    (SEQ ID NO: 135)
LDHA-1753 Target: 5'-ATATCAGTAGTGTACATTACCATATAA-3'   (SEQ ID NO: 207)

5'-UAUCAGUAGUGUACAUUACCAUAUAAU-3'    (SEQ ID NO: 424)
                 3'-AUAGUCAUCACAUGUAAUGGUAUAUUA-5'    (SEQ ID NO: 136)
LDHA-1754 Target: 5'-TATCAGTAGTGTACATTACCATATAAT-3'   (SEQ ID NO: 208)

5'-UGCAACCAACUAUCCAAGUGUUAUACC-3'    (SEQ ID NO: 425)
                 3'-ACGUUGGUUGAUAGGUUCACAAUAUGG-5'    (SEQ ID NO: 137)
LDHA-1805 Target: 5'-TGCAACCAACTATCCAAGTGTTATACC-3'   (SEQ ID NO: 209)

5'-GCAACCAACUAUCCAAGUGUUAUACCA-3'    (SEQ ID NO: 426)
                 3'-CGUUGGUUGAUAGGUUCACAAUAUGGU-5'    (SEQ ID NO: 138)
LDHA-1806 Target: 5'-GCAACCAACTATCCAAGTGTTATACCA-3'   (SEQ ID NO: 210)

5'-CAACCAACUAUCCAAGUGUUAUACCAA-3'    (SEQ ID NO: 427)
                 3'-GUUGGUUGAUAGGUUCACAAUAUGGUU-5'    (SEQ ID NO: 139)
LDHA-1807 Target: 5'-CAACCAACTATCCAAGTGTTATACCAA-3'   (SEQ ID NO: 211)
```

TABLE 5-continued

Selected Human Anti-Lactate Dehydrogenase "Blunt/Blunt" DsiRNAs

```
                  5'-AACCAACUAUCCAAGUGUUAUACCAAC-3'      (SEQ ID NO: 428)
                  3'-UUGGUUGAUAGGUUCACAAUAUGGUUG-5'      (SEQ ID NO: 140)
LDHA-1808 Target: 5'-AACCAACTATCCAAGTGTTATACCAAC-3'      (SEQ ID NO: 212)

5'-CAACUAUCCAAGUGUUAUACCAACUAA-3'      (SEQ ID NO: 429)
                  3'-GUUGAUAGGUUCACAAUAUGGUUGAUU-5'      (SEQ ID NO: 141)
LDHA-1811 Target: 5'-CAACTATCCAAGTGTTATACCAACTAA-3'      (SEQ ID NO: 213)

5'-AACUAUCCAAGUGUUAUACCAACUAAA-3'      (SEQ ID NO: 430)
                  3'-UUGAUAGGUUCACAAUAUGGUUGAUUU-5'      (SEQ ID NO: 142)
LDHA-1812 Target: 5'-AACTATCCAAGTGTTATACCAACTAAA-3'      (SEQ ID NO: 214)

5'-UAUCCAAGUGUUAUACCAACUAAAACC-3'      (SEQ ID NO: 431)
                  3'-AUAGGUUCACAAUAUGGUUGAUUUUGG-5'      (SEQ ID NO: 143)
LDHA-1815 Target: 5'-TATCCAAGTGTTATACCAACTAAAACC-3'      (SEQ ID NO: 215)

5'-AUCCAAGUGUUAUACCAACUAAAACCC-3'      (SEQ ID NO: 432)
                  3'-UAGGUUCACAAUAUGGUUGAUUUUGGG-5'      (SEQ ID NO: 144)
LDHA-1816 Target: 5'-ATCCAAGTGTTATACCAACTAAAACCC-3'      (SEQ ID NO: 216)
```

TABLE 6

DsiRNA Component 19 Nucleotide Target Sequences in Human Lactate Dehydrogenase mRNA

```
LDHA-355 19 nt Target #1:   5'-AGAAUAAGAUUACAGUUGU-3'   (SEQ ID NO: 433)

LDHA-355 19 nt Target #2:   5'-CAGAAUAAGAUUACAGUUG-3'   (SEQ ID NO: 505)

LDHA-355 19 nt Target #3:   5'-CCAGAAUAAGAUUACAGUU-3'   (SEQ ID NO: 577)

LDHA-356 19 nt Target #1:   5'-GAAUAAGAUUACAGUUGUU-3'   (SEQ ID NO: 434)

LDHA-356 19 nt Target #2:   5'-AGAAUAAGAUUACAGUUGU-3'   (SEQ ID NO: 506)

LDHA-356 19 nt Target #3:   5'-CAGAAUAAGAUUACAGUUG-3'   (SEQ ID NO: 578)

LDHA-360 19 nt Target #1:   5'-AAGAUUACAGUUGUUGGGG-3'   (SEQ ID NO: 435)

LDHA-360 19 nt Target #2:   5'-UAAGAUUACAGUUGUUGGG-3'   (SEQ ID NO: 507)

LDHA-360 19 nt Target #3:   5'-AUAAGAUUACAGUUGUUGG-3'   (SEQ ID NO: 579)

LDHA-361 19 nt Target #1:   5'-AGAUUACAGUUGUUGGGGU-3'   (SEQ ID NO: 436)

LDHA-361 19 nt Target #2:   5'-AAGAUUACAGUUGUUGGGG-3'   (SEQ ID NO: 508)

LDHA-361 19 nt Target #3:   5'-UAAGAUUACAGUUGUUGGG-3'   (SEQ ID NO: 580)

LDHA-362 19 nt Target #1:   5'-GAUUACAGUUGUUGGGGUU-3'   (SEQ ID NO: 437)

LDHA-362 19 nt Target #2:   5'-AGAUUACAGUUGUUGGGGU-3'   (SEQ ID NO: 509)

LDHA-362 19 nt Target #3:   5'-AAGAUUACAGUUGUUGGGG-3'   (SEQ ID NO: 581)

LDHA-363 19 nt Target #1:   5'-AUUACAGUUGUUGGGGUUG-3'   (SEQ ID NO: 438)

LDHA-363 19 nt Target #2:   5'-GAUUACAGUUGUUGGGGUU-3'   (SEQ ID NO: 510)

LDHA-363 19 nt Target #3:   5'-AGAUUACAGUUGUUGGGGU-3'   (SEQ ID NO: 582)

LDHA-364 19 nt Target #1:   5'-UUACAGUUGUUGGGGUUGG-3'   (SEQ ID NO: 439)

LDHA-364 19 nt Target #2:   5'-AUUACAGUUGUUGGGGUUG-3'   (SEQ ID NO: 511)

LDHA-364 19 nt Target #3:   5'-GAUUACAGUUGUUGGGGUU-3'   (SEQ ID NO: 583)

LDHA-365 19 nt Target #1:   5'-UACAGUUGUUGGGGUUGGU-3'   (SEQ ID NO: 440)

LDHA-365 19 nt Target #2:   5'-UUACAGUUGUUGGGGUUGG-3'   (SEQ ID NO: 512)

LDHA-365 19 nt Target #3:   5'-AUUACAGUUGUUGGGGUUG-3'   (SEQ ID NO: 584)

LDHA-366 19 nt Target #1:   5'-ACAGUUGUUGGGGUUGGUG-3'   (SEQ ID NO: 441)
```

TABLE 6-continued

DsiRNA Component 19 Nucleotide Target Sequences in Human Lactate Dehydrogenase mRNA

| | | |
|---|---|---|
| LDHA-366 19 nt Target #2: | 5'-UACAGUUGUUGGGGUUGGU-3' | (SEQ ID NO: 513) |
| LDHA-366 19 nt Target #3: | 5'-UUACAGUUGUUGGGGUUGG-3' | (SEQ ID NO: 585) |
| LDHA-367 19 nt Target #1: | 5'-CAGUUGUUGGGGUUGGUGC-3' | (SEQ ID NO: 442) |
| LDHA-367 19 nt Target #2: | 5'-ACAGUUGUUGGGGUUGGUG-3' | (SEQ ID NO: 514) |
| LDHA-367 19 nt Target #3: | 5'-UACAGUUGUUGGGGUUGGU-3' | (SEQ ID NO: 586) |
| LDHA-369 19 nt Target #1: | 5'-GUUGUUGGGGUUGGUGCUG-3' | (SEQ ID NO: 443) |
| LDHA-369 19 nt Target #2: | 5'-AGUUGUUGGGGUUGGUGCU-3' | (SEQ ID NO: 515) |
| LDHA-369 19 nt Target #3: | 5'-CAGUUGUUGGGGUUGGUGC-3' | (SEQ ID NO: 587) |
| LDHA-370 19 nt Target #1: | 5'-UUGUUGGGGUUGGUGCUGU-3' | (SEQ ID NO: 444) |
| LDHA-370 19 nt Target #2: | 5'-GUUGUUGGGGUUGGUGCUG-3' | (SEQ ID NO: 516) |
| LDHA-370 19 nt Target #3: | 5'-AGUUGUUGGGGUUGGUGCU-3' | (SEQ ID NO: 588) |
| LDHA-397 19 nt Target #1: | 5'-CCUGUGCCAUCAGUAUCUU-3' | (SEQ ID NO: 445) |
| LDHA-397 19 nt Target #2: | 5'-GCCUGUGCCAUCAGUAUCU-3' | (SEQ ID NO: 517) |
| LDHA-397 19 nt Target #3: | 5'-GGCCUGUGCCAUCAGUAUC-3' | (SEQ ID NO: 589) |
| LDHA-398 19 nt Target #1: | 5'-CUGUGCCAUCAGUAUCUUA-3' | (SEQ ID NO: 446) |
| LDHA-398 19 nt Target #2: | 5'-CCUGUGCCAUCAGUAUCUU-3' | (SEQ ID NO: 518) |
| LDHA-398 19 nt Target #3: | 5'-GCCUGUGCCAUCAGUAUCU-3' | (SEQ ID NO: 590) |
| LDHA-399 19 nt Target #1: | 5'-UGUGCCAUCAGUAUCUUAA-3' | (SEQ ID NO: 447) |
| LDHA-399 19 nt Target #2: | 5'-CUGUGCCAUCAGUAUCUUA-3' | (SEQ ID NO: 519) |
| LDHA-399 19 nt Target #3: | 5'-CCUGUGCCAUCAGUAUCUU-3' | (SEQ ID NO: 591) |
| LDHA-400 19 nt Target #1: | 5'-GUGCCAUCAGUAUCUUAAU-3' | (SEQ ID NO: 448) |
| LDHA-400 19 nt Target #2: | 5'-UGUGCCAUCAGUAUCUUAA-3' | (SEQ ID NO: 520) |
| LDHA-400 19 nt Target #3: | 5'-CUGUGCCAUCAGUAUCUUA-3' | (SEQ ID NO: 592) |
| LDHA-401 19 nt Target #1: | 5'-UGCCAUCAGUAUCUUAAUG-3' | (SEQ ID NO: 449) |
| LDHA-401 19 nt Target #2: | 5'-GUGCCAUCAGUAUCUUAAU-3' | (SEQ ID NO: 521) |
| LDHA-401 19 nt Target #3: | 5'-UGUGCCAUCAGUAUCUUAA-3' | (SEQ ID NO: 593) |
| LDHA-402 19 nt Target #1: | 5'-GCCAUCAGUAUCUUAAUGA-3' | (SEQ ID NO: 450) |
| LDHA-402 19 nt Target #2: | 5'-UGCCAUCAGUAUCUUAAUG-3' | (SEQ ID NO: 522) |
| LDHA-402 19 nt Target #3: | 5'-GUGCCAUCAGUAUCUUAAU-3' | (SEQ ID NO: 594) |
| LDHA-403 19 nt Target #1: | 5'-CCAUCAGUAUCUUAAUGAA-3' | (SEQ ID NO: 451) |
| LDHA-403 19 nt Target #2: | 5'-GCCAUCAGUAUCUUAAUGA-3' | (SEQ ID NO: 523) |
| LDHA-403 19 nt Target #3: | 5'-UGCCAUCAGUAUCUUAAUG-3' | (SEQ ID NO: 595) |
| LDHA-404 19 nt Target #1: | 5'-CAUCAGUAUCUUAAUGAAG-3' | (SEQ ID NO: 452) |
| LDHA-404 19 nt Target #2: | 5'-CCAUCAGUAUCUUAAUGAA-3' | (SEQ ID NO: 524) |
| LDHA-404 19 nt Target #3: | 5'-GCCAUCAGUAUCUUAAUGA-3' | (SEQ ID NO: 596) |
| LDHA-714 19 nt Target #1: | 5'-GUGGAUAUCUUGACCUACG-3' | (SEQ ID NO: 453) |
| LDHA-714 19 nt Target #2: | 5'-AGUGGAUAUCUUGACCUAC-3' | (SEQ ID NO: 525) |
| LDHA-714 19 nt Target #3: | 5'-CAGUGGAUAUCUUGACCUA-3' | (SEQ ID NO: 597) |

TABLE 6-continued

DsiRNA Component 19 Nucleotide Target Sequences in Human Lactate Dehydrogenase mRNA

| | | |
|---|---|---|
| LDHA-717 19 nt Target #1: | 5'-GAUAUCUUGACCUACGUGG-3' | (SEQ ID NO: 454) |
| LDHA-717 19 nt Target #2: | 5'-GGAUAUCUUGACCUACGUG-3' | (SEQ ID NO: 526) |
| LDHA-717 19 nt Target #3: | 5'-UGGAUAUCUUGACCUACGU-3' | (SEQ ID NO: 598) |
| LDHA-718 19 nt Target #1: | 5'-AUAUCUUGACCUACGUGGC-3' | (SEQ ID NO: 455) |
| LDHA-718 19 nt Target #2: | 5'-GAUAUCUUGACCUACGUGG-3' | (SEQ ID NO: 527) |
| LDHA-718 19 nt Target #3: | 5'-GGAUAUCUUGACCUACGUG-3' | (SEQ ID NO: 599) |
| LDHA-719 19 nt Target #1: | 5'-UAUCUUGACCUACGUGGCU-3' | (SEQ ID NO: 456) |
| LDHA-719 19 nt Target #2: | 5'-AUAUCUUGACCUACGUGGC-3' | (SEQ ID NO: 528) |
| LDHA-719 19 nt Target #3: | 5'-GAUAUCUUGACCUACGUGG-3' | (SEQ ID NO: 600) |
| LDHA-720 19 nt Target #1: | 5'-AUCUUGACCUACGUGGCUU-3' | (SEQ ID NO: 457) |
| LDHA-720 19 nt Target #2: | 5'-UAUCUUGACCUACGUGGCU-3' | (SEQ ID NO: 529) |
| LDHA-720 19 nt Target #3: | 5'-AUAUCUUGACCUACGUGGC-3' | (SEQ ID NO: 601) |
| LDHA-722 19 nt Target #1: | 5'-CUUGACCUACGUGGCUUGG-3' | (SEQ ID NO: 458) |
| LDHA-722 19 nt Target #2: | 5'-UCUUGACCUACGUGGCUUG-3' | (SEQ ID NO: 530) |
| LDHA-722 19 nt Target #3: | 5'-AUCUUGACCUACGUGGCUU-3' | (SEQ ID NO: 602) |
| LDHA-723 19 nt Target #1: | 5'-UUGACCUACGUGGCUUGGA-3' | (SEQ ID NO: 459) |
| LDHA-723 19 nt Target #2: | 5'-CUUGACCUACGUGGCUUGG-3' | (SEQ ID NO: 531) |
| LDHA-723 19 nt Target #3: | 5'-UCUUGACCUACGUGGCUUG-3' | (SEQ ID NO: 603) |
| LDHA-724 19 nt Target #1: | 5'-UGACCUACGUGGCUUGGAA-3' | (SEQ ID NO: 460) |
| LDHA-724 19 nt Target #2: | 5'-UUGACCUACGUGGCUUGGA-3' | (SEQ ID NO: 532) |
| LDHA-724 19 nt Target #3: | 5'-CUUGACCUACGUGGCUUGG-3' | (SEQ ID NO: 604) |
| LDHA-739 19 nt Target #1: | 5'-GGAAGAUAAGUGGUUUUCC-3' | (SEQ ID NO: 461) |
| LDHA-739 19 nt Target #2: | 5'-UGGAAGAUAAGUGGUUUUC-3' | (SEQ ID NO: 533) |
| LDHA-739 19 nt Target #3: | 5'-UUGGAAGAUAAGUGGUUUU-3' | (SEQ ID NO: 605) |
| LDHA-740 19 nt Target #1: | 5'-GAAGAUAAGUGGUUUUCCC-3' | (SEQ ID NO: 462) |
| LDHA-740 19 nt Target #2: | 5'-GGAAGAUAAGUGGUUUUCC-3' | (SEQ ID NO: 534) |
| LDHA-740 19 nt Target #3: | 5'-UGGAAGAUAAGUGGUUUUC-3' | (SEQ ID NO: 606) |
| LDHA-891 19 nt Target #1: | 5'-CCUGUAUGGAGUGGAAUGA-3' | (SEQ ID NO: 463) |
| LDHA-891 19 nt Target #2: | 5'-GCCUGUAUGGAGUGGAAUG-3' | (SEQ ID NO: 535) |
| LDHA-891 19 nt Target #3: | 5'-UGCCUGUAUGGAGUGGAAU-3' | (SEQ ID NO: 607) |
| LDHA-892 19 nt Target #1: | 5'-CUGUAUGGAGUGGAAUGAA-3' | (SEQ ID NO: 464) |
| LDHA-892 19 nt Target #2: | 5'-CCUGUAUGGAGUGGAAUGA-3' | (SEQ ID NO: 536) |
| LDHA-892 19 nt Target #3: | 5'-GCCUGUAUGGAGUGGAAUG-3' | (SEQ ID NO: 608) |
| LDHA-907 19 nt Target #1: | 5'-UGAAUGUUGCUGGUGUCUC-3' | (SEQ ID NO: 465) |
| LDHA-907 19 nt Target #2: | 5'-AUGAAUGUUGCUGGUGUCU-3' | (SEQ ID NO: 537) |
| LDHA-907 19 nt Target #3: | 5'-AAUGAAUGUUGCUGGUGUC-3' | (SEQ ID NO: 609) |
| LDHA-952 19 nt Target #1: | 5'-GGACUGAUAAAGAUAAGGA-3' | (SEQ ID NO: 466) |
| LDHA-952 19 nt Target #2: | 5'-GGGACUGAUAAAGAUAAGG-3' | (SEQ ID NO: 538) |
| LDHA-952 19 nt Target #3: | 5'-AGGGACUGAUAAAGAUAAG-3' | (SEQ ID NO: 610) |

TABLE 6-continued

DsiRNA Component 19 Nucleotide Target Sequences in Human Lactate Dehydrogenase mRNA LDHA-1286 19 nt Target #1: 5'-GCAAUUUUAAAGUCUUCUG-3'  (SEQ ID NO: 467)

LDHA-1286 19 nt Target #2: 5'-UGCAAUUUUAAAGUCUUCU-3'  (SEQ ID NO: 539)

LDHA-1286 19 nt Target #3: 5'-CUGCAAUUUUAAAGUCUUC-3'  (SEQ ID NO: 611)

LDHA-1287 19 nt Target #1: 5'-CAAUUUUAAAGUCUUCUGA-3'  (SEQ ID NO: 468)

LDHA-1287 19 nt Target #2: 5'-GCAAUUUUAAAGUCUUCUG-3'  (SEQ ID NO: 540)

LDHA-1287 19 nt Target #3: 5'-UGCAAUUUUAAAGUCUUCU-3'  (SEQ ID NO: 612)

LDHA-1292 19 nt Target #1: 5'-UUAAAGUCUUCUGAUGUCA-3'  (SEQ ID NO: 469)

LDHA-1292 19 nt Target #2: 5'-UUUAAAGUCUUCUGAUGUC-3'  (SEQ ID NO: 541)

LDHA-1292 19 nt Target #3: 5'-UUUUAAAGUCUUCUGAUGU-3'  (SEQ ID NO: 613)

LDHA-1293 19 nt Target #1: 5'-UAAAGUCUUCUGAUGUCAU-3'  (SEQ ID NO: 470)

LDHA-1293 19 nt Target #2: 5'-UUAAAGUCUUCUGAUGUCA-3'  (SEQ ID NO: 542)

LDHA-1293 19 nt Target #3: 5'-UUUAAAGUCUUCUGAUGUC-3'  (SEQ ID NO: 614)

LDHA-1294 19 nt Target #1: 5'-AAAGUCUUCUGAUGUCAUA-3'  (SEQ ID NO: 471)

LDHA-1294 19 nt Target #2: 5'-UAAAGUCUUCUGAUGUCAU-3'  (SEQ ID NO: 543)

LDHA-1294 19 nt Target #3: 5'-UUAAAGUCUUCUGAUGUCA-3'  (SEQ ID NO: 615)

LDHA-1359 19 nt Target #1: 5'-CAUGUUGUCCUUUUUAUCU-3'  (SEQ ID NO: 472)

LDHA-1359 19 nt Target #2: 5'-GCAUGUUGUCCUUUUUAUC-3'  (SEQ ID NO: 544)

LDHA-1359 19 nt Target #3: 5'-UGCAUGUUGUCCUUUUUAU-3'  (SEQ ID NO: 616)

LDHA-1360 19 nt Target #1: 5'-AUGUUGUCCUUUUUAUCUG-3'  (SEQ ID NO: 473)

LDHA-1360 19 nt Target #2: 5'-CAUGUUGUCCUUUUUAUCU-3'  (SEQ ID NO: 545)

LDHA-1360 19 nt Target #3: 5'-GCAUGUUGUCCUUUUUAUC-3'  (SEQ ID NO: 617)

LDHA-1361 19 nt Target #1: 5'-UGUUGUCCUUUUUAUCUGA-3'  (SEQ ID NO: 474)

LDHA-1361 19 nt Target #2: 5'-AUGUUGUCCUUUUUAUCUG-3'  (SEQ ID NO: 546)

LDHA-1361 19 nt Target #3: 5'-CAUGUUGUCCUUUUUAUCU-3'  (SEQ ID NO: 618)

LDHA-1362 19 nt Target #1: 5'-GUUGUCCUUUUUAUCUGAU-3'  (SEQ ID NO: 475)

LDHA-1362 19 nt Target #2: 5'-UGUUGUCCUUUUUAUCUGA-3'  (SEQ ID NO: 547)

LDHA-1362 19 nt Target #3: 5'-AUGUUGUCCUUUUUAUCUG-3'  (SEQ ID NO: 619)

LDHA-1363 19 nt Target #1: 5'-UUGUCCUUUUUAUCUGAUC-3'  (SEQ ID NO: 476)

LDHA-1363 19 nt Target #2: 5'-GUUGUCCUUUUUAUCUGAU-3'  (SEQ ID NO: 548)

LDHA-1363 19 nt Target #3: 5'-UGUUGUCCUUUUUAUCUGA-3'  (SEQ ID NO: 620)

LDHA-1365 19 nt Target #1: 5'-GUCCUUUUUAUCUGAUCUG-3'  (SEQ ID NO: 477)

LDHA-1365 19 nt Target #2: 5'-UGUCCUUUUUAUCUGAUCU-3'  (SEQ ID NO: 549)

LDHA-1365 19 nt Target #3: 5'-UUGUCCUUUUUAUCUGAUC-3'  (SEQ ID NO: 621)

LDHA-1366 19 nt Target #1: 5'-UCCUUUUUAUCUGAUCUGU-3'  (SEQ ID NO: 478)

LDHA-1366 19 nt Target #2: 5'-GUCCUUUUUAUCUGAUCUG-3'  (SEQ ID NO: 550)

LDHA-1366 19 nt Target #3: 5'-UGUCCUUUUUAUCUGAUCU-3'  (SEQ ID NO: 622)

LDHA-1367 19 nt Target #1: 5'-CCUUUUUAUCUGAUCUGUG-3'  (SEQ ID NO: 479)

LDHA-1367 19 nt Target #2: 5'-UCCUUUUUAUCUGAUCUGU-3'  (SEQ ID NO: 551)

TABLE 6-continued

DsiRNA Component 19 Nucleotide Target Sequences in Human Lactate Dehydrogenase mRNA

| | | |
|---|---|---|
| LDHA-1367 19 nt Target #3: | 5'-GUCCUUUUUAUCUGAUCUG-3' | (SEQ ID NO: 623) |
| LDHA-1368 19 nt Target #1: | 5'-CUUUUUAUCUGAUCUGUGA-3' | (SEQ ID NO: 480) |
| LDHA-1368 19 nt Target #2: | 5'-CCUUUUUAUCUGAUCUGUG-3' | (SEQ ID NO: 552) |
| LDHA-1368 19 nt Target #3: | 5'-UCCUUUUUAUCUGAUCUGU-3' | (SEQ ID NO: 624) |
| LDHA-1370 19 nt Target #1: | 5'-UUUUAUCUGAUCUGUGAUU-3' | (SEQ ID NO: 481) |
| LDHA-1370 19 nt Target #2: | 5'-UUUUUAUCUGAUCUGUGAU-3' | (SEQ ID NO: 553) |
| LDHA-1370 19 nt Target #3: | 5'-CUUUUUAUCUGAUCUGUGA-3' | (SEQ ID NO: 625) |
| LDHA-1371 19 nt Target #1: | 5'-UUUAUCUGAUCUGUGAUUA-3' | (SEQ ID NO: 482) |
| LDHA-1371 19 nt Target #2: | 5'-UUUUAUCUGAUCUGUGAUU-3' | (SEQ ID NO: 554) |
| LDHA-1371 19 nt Target #3: | 5'-UUUUUAUCUGAUCUGUGAU-3' | (SEQ ID NO: 626) |
| LDHA-1372 19 nt Target #1: | 5'-UUAUCUGAUCUGUGAUUAA-3' | (SEQ ID NO: 483) |
| LDHA-1372 19 nt Target #2: | 5'-UUUAUCUGAUCUGUGAUUA-3' | (SEQ ID NO: 555) |
| LDHA-1372 19 nt Target #3: | 5'-UUUUAUCUGAUCUGUGAUU-3' | (SEQ ID NO: 627) |
| LDHA-1393 19 nt Target #1: | 5'-CAGUAAUAUUUUAAGAUGG-3' | (SEQ ID NO: 484) |
| LDHA-1393 19 nt Target #2: | 5'-GCAGUAAUAUUUUAAGAUG-3' | (SEQ ID NO: 556) |
| LDHA-1393 19 nt Target #3: | 5'-AGCAGUAAUAUUUUAAGAU-3' | (SEQ ID NO: 628) |
| LDHA-1427 19 nt Target #1: | 5'-AACUCCUGAAGUUAGAAAU-3' | (SEQ ID NO: 485) |
| LDHA-1427 19 nt Target #2: | 5'-CAACUCCUGAAGUUAGAAA-3' | (SEQ ID NO: 557) |
| LDHA-1427 19 nt Target #3: | 5'-UCAACUCCUGAAGUUAGAA-3' | (SEQ ID NO: 629) |
| LDHA-1428 19 nt Target #1: | 5'-ACUCCUGAAGUUAGAAAUA-3' | (SEQ ID NO: 486) |
| LDHA-1428 19 nt Target #2: | 5'-AACUCCUGAAGUUAGAAAU-3' | (SEQ ID NO: 558) |
| LDHA-1428 19 nt Target #3: | 5'-CAACUCCUGAAGUUAGAAA-3' | (SEQ ID NO: 630) |
| LDHA-1512 19 nt Target #1: | 5'-AACUGGUUAGUGUGAAAUA-3' | (SEQ ID NO: 487) |
| LDHA-1512 19 nt Target #2: | 5'-CAACUGGUUAGUGUGAAAU-3' | (SEQ ID NO: 559) |
| LDHA-1512 19 nt Target #3: | 5'-UCAACUGGUUAGUGUGAAA-3' | (SEQ ID NO: 631) |
| LDHA-1513 19 nt Target #1: | 5'-ACUGGUUAGUGUGAAAUAG-3' | (SEQ ID NO: 488) |
| LDHA-1513 19 nt Target #2: | 5'-AACUGGUUAGUGUGAAAUA-3' | (SEQ ID NO: 560) |
| LDHA-1513 19 nt Target #3: | 5'-CAACUGGUUAGUGUGAAAU-3' | (SEQ ID NO: 632) |
| LDHA-1514 19 nt Target #1: | 5'-CUGGUUAGUGUGAAAUAGU-3' | (SEQ ID NO: 489) |
| LDHA-1514 19 nt Target #2: | 5'-ACUGGUUAGUGUGAAAUAG-3' | (SEQ ID NO: 561) |
| LDHA-1514 19 nt Target #3: | 5'-AACUGGUUAGUGUGAAAUA-3' | (SEQ ID NO: 633) |
| LDHA-1516 19 nt Target #1: | 5'-GGUUAGUGUGAAAUAGUUC-3' | (SEQ ID NO: 490) |
| LDHA-1516 19 nt Target #2: | 5'-UGGUUAGUGUGAAAUAGUU-3' | (SEQ ID NO: 562) |
| LDHA-1516 19 nt Target #3: | 5'-CUGGUUAGUGUGAAAUAGU-3' | (SEQ ID NO: 634) |
| LDHA-1684 19 nt Target #1: | 5'-AUCCAGUGUAUAAAUCCAA-3' | (SEQ ID NO: 491) |
| LDHA-1684 19 nt Target #2: | 5'-GAUCCAGUGUAUAAAUCCA-3' | (SEQ ID NO: 563) |
| LDHA-1684 19 nt Target #3: | 5'-GGAUCCAGUGUAUAAAUCC-3' | (SEQ ID NO: 635) |
| LDHA-1688 19 nt Target #1: | 5'-AGUGUAUAAAUCCAAUAUC-3' | (SEQ ID NO: 492) |
| LDHA-1688 19 nt Target #2: | 5'-CAGUGUAUAAAUCCAAUAU-3' | (SEQ ID NO: 564) |

TABLE 6-continued

DsiRNA Component 19 Nucleotide Target Sequences in Human Lactate Dehydrogenase mRNA

```
LDHA-1688 19 nt Target #3: 5'-CCAGUGUAUAAAUCCAAUA-3'  (SEQ ID NO: 636)

LDHA-1736 19 nt Target #1: 5'-CUUAUUUUGUGAACUAUAU-3'  (SEQ ID NO: 493)

LDHA-1736 19 nt Target #2: 5'-UCUUAUUUUGUGAACUAUA-3'  (SEQ ID NO: 565)

LDHA-1736 19 nt Target #3: 5'-AUCUUAUUUUGUGAACUAU-3'  (SEQ ID NO: 637)

LDHA-1750 19 nt Target #1: 5'-UAUAUCAGUAGUGUACAUU-3'  (SEQ ID NO: 494)

LDHA-1750 19 nt Target #2: 5'-CUAUAUCAGUAGUGUACAU-3'  (SEQ ID NO: 566)

LDHA-1750 19 nt Target #3: 5'-ACUAUAUCAGUAGUGUACA-3'  (SEQ ID NO: 638)

LDHA-1753 19 nt Target #1: 5'-AUCAGUAGUGUACAUUACC-3'  (SEQ ID NO: 495)

LDHA-1753 19 nt Target #2: 5'-UAUCAGUAGUGUACAUUAC-3'  (SEQ ID NO: 567)

LDHA-1753 19 nt Target #3: 5'-AUAUCAGUAGUGUACAUUA-3'  (SEQ ID NO: 639)

LDHA-1754 19 nt Target #1: 5'-UCAGUAGUGUACAUUACCA-3'  (SEQ ID NO: 496)

LDHA-1754 19 nt Target #2: 5'-AUCAGUAGUGUACAUUACC-3'  (SEQ ID NO: 568)

LDHA-1754 19 nt Target #3: 5'-UAUCAGUAGUGUACAUUAC-3'  (SEQ ID NO: 640)

LDHA-1805 19 nt Target #1: 5'-CAACCAACUAUCCAAGUGU-3'  (SEQ ID NO: 497)

LDHA-1805 19 nt Target #2: 5'-GCAACCAACUAUCCAAGUG-3'  (SEQ ID NO: 569)

LDHA-1805 19 nt Target #3: 5'-UGCAACCAACUAUCCAAGU-3'  (SEQ ID NO: 641)

LDHA-1806 19 nt Target #1: 5'-AACCAACUAUCCAAGUGUU-3'  (SEQ ID NO: 498)

LDHA-1806 19 nt Target #2: 5'-CAACCAACUAUCCAAGUGU-3'  (SEQ ID NO: 570)

LDHA-1806 19 nt Target #3: 5'-GCAACCAACUAUCCAAGUG-3'  (SEQ ID NO: 642)

LDHA-1807 19 nt Target #1: 5'-ACCAACUAUCCAAGUGUUA-3'  (SEQ ID NO: 499)

LDHA-1807 19 nt Target #2: 5'-AACCAACUAUCCAAGUGUU-3'  (SEQ ID NO: 571)

LDHA-1807 19 nt Target #3: 5'-CAACCAACUAUCCAAGUGU-3'  (SEQ ID NO: 643)

LDHA-1808 19 nt Target #1: 5'-CCAACUAUCCAAGUGUUAU-3'  (SEQ ID NO: 500)

LDHA-1808 19 nt Target #2: 5'-ACCAACUAUCCAAGUGUUA-3'  (SEQ ID NO: 572)

LDHA-1808 19 nt Target #3: 5'-AACCAACUAUCCAAGUGUU-3'  (SEQ ID NO: 644)

LDHA-1811 19 nt Target #1: 5'-ACUAUCCAAGUGUUAUACC-3'  (SEQ ID NO: 501)

LDHA-1811 19 nt Target #2: 5'-AACUAUCCAAGUGUUAUAC-3'  (SEQ ID NO: 573)

LDHA-1811 19 nt Target #3: 5'-CAACUAUCCAAGUGUUAUA-3'  (SEQ ID NO: 645)

LDHA-1812 19 nt Target #1: 5'-CUAUCCAAGUGUUAUACCA-3'  (SEQ ID NO: 502)

LDHA-1812 19 nt Target #2: 5'-ACUAUCCAAGUGUUAUACC-3'  (SEQ ID NO: 574)

LDHA-1812 19 nt Target #3: 5'-AACUAUCCAAGUGUUAUAC-3'  (SEQ ID NO: 646)

LDHA-1815 19 nt Target #1: 5'-UCCAAGUGUUAUACCAACU-3'  (SEQ ID NO: 503)

LDHA-1815 19 nt Target #2: 5'-AUCCAAGUGUUAUACCAAC-3'  (SEQ ID NO: 575)

LDHA-1815 19 nt Target #3: 5'-UAUCCAAGUGUUAUACCAA-3'  (SEQ ID NO: 647)

LDHA-1816 19 nt Target #1: 5'-CCAAGUGUUAUACCAACUA-3'  (SEQ ID NO: 504)

LDHA-1816 19 nt Target #2: 5'-UCCAAGUGUUAUACCAACU-3'  (SEQ ID NO: 576)

LDHA-1816 19 nt Target #3: 5'-AUCCAAGUGUUAUACCAAC-3'  (SEQ ID NO: 648)
```

TABLE 7

Selected Mouse Anti-Lactate Dehydrogenase DsiRNA Agents (Asymmetrics)

| | | |
|---|---|---|
| LDHA-m367 | 5'-CAAGGACCAGCUGAUUGUGAAUCtt-3'<br>3'-GAGUUCCUGGUCGACUAACACUUAGAA-5'<br>Target: 5'-CTCAAGGACCAGCTGATTGTGAATCTT-3' | (SEQ ID NO: 649)<br>(SEQ ID NO: 697)<br>(SEQ ID NO: 745) |
| LDHA-m368 | 5'-AAGGACCAGCUGAUUGUGAAUCUtc-3'<br>3'-AGUUCCUGGUCGACUAACACUUAGAAG-5'<br>Target: 5'-TCAAGGACCAGCTGATTGTGAATCTTC-3' | (SEQ ID NO: 650)<br>(SEQ ID NO: 698)<br>(SEQ ID NO: 746) |
| LDHA-m372 | 5'-ACCAGCUGAUUGUGAAUCUUCUUaa-3'<br>3'-CCUGGUCGACUAACACUUAGAAGAAUU-5'<br>Target: 5'-GGACCAGCTGATTGTGAATCTTCTTAA-3' | (SEQ ID NO: 651)<br>(SEQ ID NO: 699)<br>(SEQ ID NO: 747) |
| LDHA-m376 | 5'-GCUGAUUGUGAAUCUUCUUAAGGaa-3'<br>3'-GUCGACUAACACUUAGAAGAAUUCCUU-5'<br>Target: 5'-CAGCTGATTGTGAATCTTCTTAAGGAA-3' | (SEQ ID NO: 652)<br>(SEQ ID NO: 700)<br>(SEQ ID NO: 748) |
| LDHA-m456 | 5'-CUUGUGCCAUCAGUAUCUUAAUGaa-3'<br>3'-CCGAACACGGUAGUCAUAGAAUUACUU-5'<br>Target: 5'-GGCTTGTGCCATCAGTATCTTAATGAA-3' | (SEQ ID NO: 653)<br>(SEQ ID NO: 701)<br>(SEQ ID NO: 749) |
| LDHA-m501 | 5'-CCCUUGUUGACGUCAUGGAAGACaa-3'<br>3'-ACGGGAACAACUGCAGUACCUUCUGUU-5'<br>Target: 5'-TGCCCTTGTTGACGTCATGGAAGACAA-3' | (SEQ ID NO: 654)<br>(SEQ ID NO: 702)<br>(SEQ ID NO: 750) |
| LDHA-m506 | 5'-GUUGACGUCAUGGAAGACAAACUca-3'<br>3'-AACAACUGCAGUACCUUCUGUUUGAGU-5'<br>Target: 5'-TTGTTGACGTCATGGAAGACAAACTCA-3' | (SEQ ID NO: 655)<br>(SEQ ID NO: 703)<br>(SEQ ID NO: 751) |
| LDHA-m507 | 5'-UUGACGUCAUGGAAGACAAACUCaa-3'<br>3'-ACAACUGCAGUACCUUCUGUUUGAGUU-5'<br>Target: 5'-TGTTGACGTCATGGAAGACAAACTCAA-3' | (SEQ ID NO: 656)<br>(SEQ ID NO: 704)<br>(SEQ ID NO: 752) |
| LDHA-m584 | 5'-AUUGUCUCCAGCAAAGACUACUGtg-3'<br>3'-UUUAACAGAGGUCGUUUCUGAUGACAC-5'<br>Target: 5'-AAATTGTCTCCAGCAAAGACTACTGTG-3' | (SEQ ID NO: 657)<br>(SEQ ID NO: 705)<br>(SEQ ID NO: 753) |
| LDHA-m689 | 5'-CGAAACGUGAACAUCUUCAAGUUca-3'<br>3'-UCGCUUUGCACUUGUAGAAGUUCAAGU-5'<br>Target: 5'-AGCGAAACGTGAACATCTTCAAGTTCA-3' | (SEQ ID NO: 658)<br>(SEQ ID NO: 706)<br>(SEQ ID NO: 754) |
| LDHA-m694 | 5'-CGUGAACAUCUUCAAGUUCAUCAtt-3'<br>3'-UUGCACUUGUAGAAGUUCAAGUAGUAA-5'<br>Target: 5'-AACGTGAACATCTTCAAGTTCATCATT-3' | (SEQ ID NO: 659)<br>(SEQ ID NO: 707)<br>(SEQ ID NO: 755) |
| LDHA-m695 | 5'-GUGAACAUCUUCAAGUUCAUCAUtc-3'<br>3'-UGCACUUGUAGAAGUUCAAGUAGUAAG-5'<br>Target: 5'-ACGTGAACATCTTCAAGTTCATCATTC-3' | (SEQ ID NO: 660)<br>(SEQ ID NO: 708)<br>(SEQ ID NO: 756) |
| LDHA-m823 | 5'-CCGAGUAAUUGGAAGUGGUUGCAat-3'<br>3'-UUGGCUCAUUAACCUUCACCAACGUUA-5'<br>Target: 5'-AACCGAGTAATTGGAAGTGGTTGCAAT-3' | (SEQ ID NO: 661)<br>(SEQ ID NO: 709)<br>(SEQ ID NO: 757) |
| LDHA-m1071 | 5'-ACGAGGUGAUCAAGCUGAAAGGUta-3'<br>3'-GAUGCUCCACUAGUUCGACUUUCCAAU-5'<br>Target: 5'-CTACGAGGTGATCAAGCTGAAAGGTTA-3' | (SEQ ID NO: 662)<br>(SEQ ID NO: 710)<br>(SEQ ID NO: 758) |
| LDHA-m1133 | 5'-GCUGAGAGCAUAAUGAAGAACCUta-3'<br>3'-ACCGACUCUCGUAUUACUUCUUGGAAU-5'<br>Target: 5'-TGGCTGAGAGCATAATGAAGAACCTTA-3' | (SEQ ID NO: 663)<br>(SEQ ID NO: 711)<br>(SEQ ID NO: 759) |
| LDHA-m1183 | 5'-GAUUAAGGGUCUCUAUGGAAUCAat-3'<br>3'-UACUAAUUCCCAGAGAUACCUUAGUUA-5'<br>Target: 5'-ATGATTAAGGGTCTCTATGGAATCAAT-3' | (SEQ ID NO: 664)<br>(SEQ ID NO: 712)<br>(SEQ ID NO: 760) |
| LDHA-m1245 | 5'-AAAAUGGAAUCUCGGAUGUUGUGaa-3'<br>3'-UGUUUUACCUUAGAGCCUACAACACUU-5'<br>Target: 5'-ACAAAATGGAATCTCGGATGTTGTGAA-3' | (SEQ ID NO: 665)<br>(SEQ ID NO: 713)<br>(SEQ ID NO: 761) |
| LDHA-m1250 | 5'-GGAAUCUCGGAUGUUGUGAAGGUga-3'<br>3'-UACCUUAGAGCCUACAACACUUCCACU-5'<br>Target: 5'-ATGGAATCTCGGATGTTGTGAAGGTGA-3' | (SEQ ID NO: 666)<br>(SEQ ID NO: 714)<br>(SEQ ID NO: 762) |
| LDHA-m1257 | 5'-CGGAUGUUGUGAAGGUGACACUGac-3'<br>3'-GAGCCUACAACACUUCCACUGUGACUG-5'<br>Target: 5'-CTCGGATGTTGTGAAGGTGACACTGAC-3' | (SEQ ID NO: 667)<br>(SEQ ID NO: 715)<br>(SEQ ID NO: 763) |

TABLE 7-continued

Selected Mouse Anti-Lactate Dehydrogenase DsiRNA Agents (Asymmetrics)

| | | |
|---|---|---|
| | 5'-GAUGCAUAUCUUGUGCAUAAAUGtt-3' | (SEQ ID NO: 668) |
| | 3'-UACUACGUAUAGAACACGUAUUUACAA-5' | (SEQ ID NO: 716) |
| LDHA-m1687 Target: | 5'-ATGATGCATATCTTGTGCATAAATGTT-3' | (SEQ ID NO: 764) |
| | 5'-AUGCAUAUCUUGUGCAUAAAUGUtg-3' | (SEQ ID NO: 669) |
| | 3'-ACUACGUAUAGAACACGUAUUUACAAC-5' | (SEQ ID NO: 717) |
| LDHA-m1688 Target: | 5'-TGATGCATATCTTGTGCATAAATGTTG-3' | (SEQ ID NO: 765) |
| | 5'-GCAUAUCUUGUGCAUAAAUGUUGta-3' | (SEQ ID NO: 670) |
| | 3'-UACGUAUAGAACACGUAUUUACAACAU-5' | (SEQ ID NO: 718) |
| LDHA-m1690 Target: | 5'-ATGCATATCTTGTGCATAAATGTTGTA-3' | (SEQ ID NO: 766) |
| | 5'-CAUAUCUUGUGCAUAAAUGUUGUac-3' | (SEQ ID NO: 671) |
| | 3'-ACGUAUAGAACACGUAUUUACAACAUG-5' | (SEQ ID NO: 719) |
| LDHA-m1691 Target: | 5'-TGCATATCTTGTGCATAAATGTTGTAC-3' | (SEQ ID NO: 767) |
| | 5'-AUAUCUUGUGCAUAAAUGUUGUAca-3' | (SEQ ID NO: 672) |
| | 3'-CGUAUAGAACACGUAUUUACAACAUGU-5' | (SEQ ID NO: 720) |
| LDHA-m1692 Target: | 5'-GCATATCTTGTGCATAAATGTTGTACA-3' | (SEQ ID NO: 768) |
| | 5'-AUCUUGUGCAUAAAUGUUGUACAgg-3' | (SEQ ID NO: 673) |
| | 3'-UAUAGAACACGUAUUUACAACAUGUCC-5' | (SEQ ID NO: 721) |
| LDHA-m1694 Target: | 5'-ATATCTTGTGCATAAATGTTGTACAGG-3' | (SEQ ID NO: 769) |
| | 5'-UCUUGUGCAUAAAUGUUGUACAGga-3' | (SEQ ID NO: 674) |
| | 3'-AUAGAACACGUAUUUACAACAUGUCCU-5' | (SEQ ID NO: 722) |
| LDHA-m1695 Target: | 5'-TATCTTGTGCATAAATGTTGTACAGGA-3' | (SEQ ID NO: 770) |
| | 5'-UUGUGCAUAAAUGUUGUACAGGAta-3' | (SEQ ID NO: 675) |
| | 3'-AGAACACGUAUUUACAACAUGUCCUAU-5' | (SEQ ID NO: 723) |
| LDHA-m1697 Target: | 5'-TCTTGTGCATAAATGTTGTACAGGATA-3' | (SEQ ID NO: 771) |
| | 5'-UGUGCAUAAAUGUUGUACAGGAUat-3' | (SEQ ID NO: 676) |
| | 3'-GAACACGUAUUUACAACAUGUCCUAUA-5' | (SEQ ID NO: 724) |
| LDHA-m1698 Target: | 5'-CTTGTGCATAAATGTTGTACAGGATAT-3' | (SEQ ID NO: 772) |
| | 5'-GUGCAUAAAUGUUGUACAGGAUAtt-3' | (SEQ ID NO: 677) |
| | 3'-AACACGUAUUUACAACAUGUCCUAUAA-5' | (SEQ ID NO: 725) |
| LDHA-m1699 Target: | 5'-TTGTGCATAAATGTTGTACAGGATATT-3' | (SEQ ID NO: 773) |
| | 5'-UGCAUAAAUGUUGUACAGGAUAUtt-3' | (SEQ ID NO: 678) |
| | 3'-ACACGUAUUUACAACAUGUCCUAUAAA-5' | (SEQ ID NO: 726) |
| LDHA-m1700 Target: | 5'-TGTGCATAAATGTTGTACAGGATATTT-3' | (SEQ ID NO: 774) |
| | 5'-GCAUAAAUGUUGUACAGGAUAUUtt-3' | (SEQ ID NO: 679) |
| | 3'-CACGUAUUUACAACAUGUCCUAUAAAA-5' | (SEQ ID NO: 727) |
| LDHA-m1701 Target: | 5'-GTGCATAAATGTTGTACAGGATATTTT-3' | (SEQ ID NO: 775) |
| | 5'-CAUAAAUGUUGUACAGGAUAUUUta-3' | (SEQ ID NO: 680) |
| | 3'-ACGUAUUUACAACAUGUCCUAUAAAAU-5' | (SEQ ID NO: 728) |
| LDHA-m1702 Target: | 5'-TGCATAAATGTTGTACAGGATATTTTA-3' | (SEQ ID NO: 776) |
| | 5'-AUAAAUGUUGUACAGGAUAUUUUat-3' | (SEQ ID NO: 681) |
| | 3'-CGUAUUUACAACAUGUCCUAUAAAAUA-5' | (SEQ ID NO: 729) |
| LDHA-m1703 Target: | 5'-GCATAAATGTTGTACAGGATATTTTAT-3' | (SEQ ID NO: 777) |
| | 5'-UAAAUGUUGUACAGGAUAUUUUAta-3' | (SEQ ID NO: 682) |
| | 3'-GUAUUUACAACAUGUCCUAUAAAAUAU-5' | (SEQ ID NO: 730) |
| LDHA-m1704 Target: | 5'-CATAAATGTTGTACAGGATATTTTATA-3' | (SEQ ID NO: 778) |
| | 5'-AAAUGUUGUACAGGAUAUUUUAUat-3' | (SEQ ID NO: 683) |
| | 3'-UAUUUACAACAUGUCCUAUAAAAUAUA-5' | (SEQ ID NO: 731) |
| LDHA-m1705 Target: | 5'-ATAAATGTTGTACAGGATATTTTATAT-3' | (SEQ ID NO: 779) |
| | 5'-AAUGUUGUACAGGAUAUUUUAUAta-3' | (SEQ ID NO: 684) |
| | 3'-AUUUACAACAUGUCCUAUAAAAUAUAU-5' | (SEQ ID NO: 732) |
| LDHA-m1706 Target: | 5'-TAAATGTTGTACAGGATATTTTATATA-3' | (SEQ ID NO: 780) |
| | 5'-AUGUUGUACAGGAUAUUUUAUAUat-3' | (SEQ ID NO: 685) |
| | 3'-UUUACAACAUGUCCUAUAAAAUAUAUA-5' | (SEQ ID NO: 733) |
| LDHA-m1707 Target: | 5'-AAATGTTGTACAGGATATTTTATATAT-3' | (SEQ ID NO: 781) |
| | 5'-UGUUGUACAGGAUAUUUUAUAUAtt-3' | (SEQ ID NO: 686) |
| | 3'-UUACAACAUGUCCUAUAAAAUAUAUAA-5' | (SEQ ID NO: 734) |
| LDHA-m1708 Target: | 5'-AATGTTGTACAGGATATTTTATATATT-3' | (SEQ ID NO: 782) |

TABLE 7-continued

Selected Mouse Anti-Lactate Dehydrogenase DsiRNA Agents (Asymmetrics)

```
                5'-GUUGUACAGGAUAUUUAUAUAUta-3'      (SEQ ID NO: 687)
                3'-UACAACAUGUCCUAUAAAAUAUAUAAU-5'   (SEQ ID NO: 735)
LDHA-m1709 Target: 5'-ATGTTGTACAGGATATTTTATATATTA-3' (SEQ ID NO: 783)

5'-UUGUACAGGAUAUUUAUAUAUUat-3'      (SEQ ID NO: 688)
                3'-ACAACAUGUCCUAUAAAAUAUAUAAUA-5'   (SEQ ID NO: 736)
LDHA-m1710 Target: 5'-TGTTGTACAGGATATTTTATATATTAT-3' (SEQ ID NO: 784)

5'-GUCUGUAGUGUGCAUUGCAAUAUta-3'     (SEQ ID NO: 689)
                3'-CACAGACAUCACACGUAACGUUAUAAU-5'   (SEQ ID NO: 737)
LDHA-m1739 Target: 5'-GTGTCTGTAGTGTGCATTGCAATATTA-3' (SEQ ID NO: 785)

5'-GUAGUGUGCAUUGCAAUAUUAUGtg-3'     (SEQ ID NO: 690)
                3'-GACAUCACACGUAACGUUAUAAUACAC-5'   (SEQ ID NO: 738)
LDHA-m1743 Target: 5'-CTGTAGTGTGCATTGCAATATTATGTG-3' (SEQ ID NO: 786)

5'-UAGUGUGCAUUGCAAUAUUAUGUga-3'     (SEQ ID NO: 691)
                3'-ACAUCACACGUAACGUUAUAAUACACU-5'   (SEQ ID NO: 739)
LDHA-m1744 Target: 5'-TGTAGTGTGCATTGCAATATTATGTGA-3' (SEQ ID NO: 787)

5'-GUGUGCAUUGCAAUAUUAUGUGAga-3'     (SEQ ID NO: 692)
                3'-AUCACACGUAACGUUAUAAUACACUCU-5'   (SEQ ID NO: 740)
LDHA-m1746 Target: 5'-TAGTGTGCATTGCAATATTATGTGAGA-3' (SEQ ID NO: 788)

5'-CAUUGCAAUAUUAUGUGAGAUGUaa-3'     (SEQ ID NO: 693)
                3'-ACGUAACGUUAUAAUACACUCUACAUU-5'   (SEQ ID NO: 741)
LDHA-m1751 Target: 5'-TGCATTGCAATATTATGTGAGATGTAA-3' (SEQ ID NO: 789)

5'-AUUGCAAUAUUAUGUGAGAUGUAag-3'     (SEQ ID NO: 694)
                3'-CGUAACGUUAUAAUACACUCUACAUUC-5'   (SEQ ID NO: 742)
LDHA-m1752 Target: 5'-GCATTGCAATATTATGTGAGATGTAAG-3' (SEQ ID NO: 790)

5'-GCAAUAUUAUGUGAGAUGUAAGAtc-3'     (SEQ ID NO: 695)
                3'-AACGUUAUAAUACACUCUACAUUCUAG-5'   (SEQ ID NO: 743)
LDHA-m1755 Target: 5'-TTGCAATATTATGTGAGATGTAAGATC-3' (SEQ ID NO: 791)

5'-CAAUAUUAUGUGAGAUGUAAGAUct-3'     (SEQ ID NO: 696)
                3'-ACGUUAUAAUACACUCUACAUUCUAGA-5'   (SEQ ID NO: 744)
LDHA-m1756 Target: 5'-TGCAATATTATGTGAGATGTAAGATCT-3' (SEQ ID NO: 792)
```

TABLE 8

Selected Mouse Anti-Lactate Dehydrogenase DsiRNAs, Unmodified Duplexes (Asymmetrics)

```
                5'-CAAGGACCAGCUGAUUGUGAAUCUU-3'    (SEQ ID NO: 793)
                3'-GAGUUCCUGGUCGACUAACACUUAGAA-5'  (SEQ ID NO: 697)
LDHA-m367 Target: 5'-CTCAAGGACCAGCTGATTGTGAATCTT-3' (SEQ ID NO: 745)

5'-AAGGACCAGCUGAUUGUGAAUCUUC-3'    (SEQ ID NO: 794)
                3'-AGUUCCUGGUCGACUAACACUUAGAAG-5'  (SEQ ID NO: 698)
LDHA-m368 Target: 5'-TCAAGGACCAGCTGATTGTGAATCTTC-3' (SEQ ID NO: 746)

5'-ACCAGCUGAUUGUGAAUCUUCUUAA-3'    (SEQ ID NO: 795)
                3'-CCUGGUCGACUAACACUUAGAAGAAUU-5'  (SEQ ID NO: 699)
LDHA-m372 Target: 5'-GGACCAGCTGATTGTGAATCTTCTTAA-3' (SEQ ID NO: 747)

5'-GCUGAUUGUGAAUCUUCUUAAGGAA-3'    (SEQ ID NO: 796)
                3'-GUCGACUAACACUUAGAAGAAUUCCUU-5'  (SEQ ID NO: 700)
LDHA-m376 Target: 5'-CAGCTGATTGTGAATCTTCTTAAGGAA-3' (SEQ ID NO: 748)

5'-CUUGUGCCAUCAGUAUCUUAAUGAA-3'    (SEQ ID NO: 797)
                3'-CCGAACACGGUAGUCAUAGAAUUACUU-5'  (SEQ ID NO: 701)
LDHA-m456 Target: 5'-GGCTTGTGCCATCAGTATCTTAATGAA-3' (SEQ ID NO: 749)

5'-CCCUUGUUGACGUCAUGGAAGACAA-3'    (SEQ ID NO: 798)
                3'-ACGGGAACAACUGCAGUACCUUCUGUU-5'  (SEQ ID NO: 702)
LDHA-m501 Target: 5'-TGCCCTTGTTGACGTCATGGAAGACAA-3' (SEQ ID NO: 750)

5'-GUUGACGUCAUGGAAGACAAACUCA-3'    (SEQ ID NO: 799)
                3'-AACAACUGCAGUACCUUCUGUUUGAGU-5'  (SEQ ID NO: 703)
LDHA-m506 Target: 5'-TTGTTGACGTCATGGAAGACAAACTCA-3' (SEQ ID NO: 751)
```

TABLE 8-continued

Selected Mouse Anti-Lactate Dehydrogenase DsiRNAs, Unmodified
Duplexes (Asymmetrics)

|  |  |  |
| --- | --- | --- |
|  | 5'-UUGACGUCAUGGAAGACAAACUCAA-3' | (SEQ ID NO: 800) |
|  | 3'-ACAACUGCAGUACCUUCUGUUUGAGUU-5' | (SEQ ID NO: 704) |
| LDHA-m507 Target: | 5'-TGTTGACGTCATGGAAGACAAACTCAA-3' | (SEQ ID NO: 752) |
|  | 5'-AUUGUCUCCAGCAAAGACUACUGUG-3' | (SEQ ID NO: 801) |
|  | 3'-UUUAACAGAGGUCGUUUCUGAUGACAC-5' | (SEQ ID NO: 705) |
| LDHA-m584 Target: | 5'-AAATTGTCTCCAGCAAAGACTACTGTG-3' | (SEQ ID NO: 753) |
|  | 5'-CGAAACGUGAACAUCUUCAAGUUCA-3' | (SEQ ID NO: 802) |
|  | 3'-UCGCUUUGCACUUGUAGAAGUUCAAGU-5' | (SEQ ID NO: 706) |
| LDHA-m689 Target: | 5'-AGCGAAACGTGAACATCTTCAAGTTCA-3' | (SEQ ID NO: 754) |
|  | 5'-CGUGAACAUCUUCAAGUUCAUCAUU-3' | (SEQ ID NO: 803) |
|  | 3'-UUGCACUUGUAGAAGUUCAAGUAGUAA-5' | (SEQ ID NO: 707) |
| LDHA-m694 Target: | 5'-AACGTGAACATCTTCAAGTTCATCATT-3' | (SEQ ID NO: 755) |
|  | 5'-GUGAACAUCUUCAAGUUCAUCAUUC-3' | (SEQ ID NO: 804) |
|  | 3'-UGCACUUGUAGAAGUUCAAGUAGUAAG-5' | (SEQ ID NO: 708) |
| LDHA-m695 Target: | 5'-ACGTGAACATCTTCAAGTTCATCATTC-3' | (SEQ ID NO: 756) |
|  | 5'-CCGAGUAAUUGGAAGUGGUUGCAAU-3' | (SEQ ID NO: 805) |
|  | 3'-UUGGCUCAUUAACCUUCACCAACGUUA-5' | (SEQ ID NO: 709) |
| LDHA-m823 Target: | 5'-AACCGAGTAATTGGAAGTGGTTGCAAT-3' | (SEQ ID NO: 757) |
|  | 5'-ACGAGGUGAUCAAGCUGAAAGGUUA-3' | (SEQ ID NO: 806) |
|  | 3'-GAUGCUCCACUAGUUCGACUUUCCAAU-5' | (SEQ ID NO: 710) |
| LDHA-m1071 Target: | 5'-CTACGAGGTGATCAAGCTGAAAGGTTA-3' | (SEQ ID NO: 758) |
|  | 5'-GCUGAGAGCAUAAUGAAGAACCUUA-3' | (SEQ ID NO: 807) |
|  | 3'-ACCGACUCUCGUAUUACUUCUUGGAAU-5' | (SEQ ID NO: 711) |
| LDHA-m1133 Target: | 5'-TGGCTGAGAGCATAATGAAGAACCTTA-3' | (SEQ ID NO: 759) |
|  | 5'-GAUUAAGGGUCUCUAUGGAAUCAAU-3' | (SEQ ID NO: 808) |
|  | 3'-UACUAAUUCCCAGAGAUACCUUAGUUA-5' | (SEQ ID NO: 712) |
| LDHA-m1183 Target: | 5'-ATGATTAAGGGTCTCTATGGAATCAAT-3' | (SEQ ID NO: 760) |
|  | 5'-AAAAUGGAAUCUCGGAUGUUGUGAA-3' | (SEQ ID NO: 809) |
|  | 3'-UGUUUUACCUUAGAGCCUACAACACUU-5' | (SEQ ID NO: 713) |
| LDHA-m1245 Target: | 5'-ACAAAATGGAATCTCGGATGTTGTGAA-3' | (SEQ ID NO: 761) |
|  | 5'-GGAAUCUCGGAUGUUGUGAAGGUGA-3' | (SEQ ID NO: 810) |
|  | 3'-UACCUUAGAGCCUACAACACUUCCACU-5' | (SEQ ID NO: 714) |
| LDHA-m1250 Target: | 5'-ATGGAATCTCGGATGTTGTGAAGGTGA-3' | (SEQ ID NO: 762) |
|  | 5'-CGGAUGUUGUGAAGGUGACACUGAC-3' | (SEQ ID NO: 811) |
|  | 3'-GAGCCUACAACACUUCCACUGUGACUG-5' | (SEQ ID NO: 715) |
| LDHA-m1257 Target: | 5'-CTCGGATGTTGTGAAGGTGACACTGAC-3' | (SEQ ID NO: 763) |
|  | 5'-GAUGCAUAUCUUGUGCAUAAAUGUU-3' | (SEQ ID NO: 812) |
|  | 3'-UACUACGUAUAGAACACGUAUUUACAA-5' | (SEQ ID NO: 716) |
| LDHA-m1687 Target: | 5'-ATGATGCATATCTTGTGCATAAATGTT-3' | (SEQ ID NO: 764) |
|  | 5'-AUGCAUAUCUUGUGCAUAAAUGUUG-3' | (SEQ ID NO: 813) |
|  | 3'-ACUACGUAUAGAACACGUAUUUACAAC-5' | (SEQ ID NO: 717) |
| LDHA-m1688 Target: | 5'-TGATGCATATCTTGTGCATAAATGTTG-3' | (SEQ ID NO: 765) |
|  | 5'-GCAUAUCUUGUGCAUAAAUGUUGUA-3' | (SEQ ID NO: 814) |
|  | 3'-UACGUAUAGAACACGUAUUUACAACAU-5' | (SEQ ID NO: 718) |
| LDHA-m1690 Target: | 5'-ATGCATATCTTGTGCATAAATGTTGTA-3' | (SEQ ID NO: 766) |
|  | 5'-CAUAUCUUGUGCAUAAAUGUUGUAC-3' | (SEQ ID NO: 815) |
|  | 3'-ACGUAUAGAACACGUAUUUACAACAUG-5' | (SEQ ID NO: 719) |
| LDHA-m1691 Target: | 5'-TGCATATCTTGTGCATAAATGTTGTAC-3' | (SEQ ID NO: 767) |
|  | 5'-AUAUCUUGUGCAUAAAUGUUGUACA-3' | (SEQ ID NO: 816) |
|  | 3'-CGUAUAGAACACGUAUUUACAACAUGU-5' | (SEQ ID NO: 720) |
| LDHA-m1692 Target: | 5'-GCATATCTTGTGCATAAATGTTGTACA-3' | (SEQ ID NO: 768) |
|  | 5'-AUCUUGUGCAUAAAUGUUGUACAGG-3' | (SEQ ID NO: 817) |
|  | 3'-UAUAGAACACGUAUUUACAACAUGUCC-5' | (SEQ ID NO: 721) |
| LDHA-m1694 Target: | 5'-ATATCTTGTGCATAAATGTTGTACAGG-3' | (SEQ ID NO: 769) |
|  | 5'-UCUUGUGCAUAAAUGUUGUACAGGA-3' | (SEQ ID NO: 818) |
|  | 3'-AUAGAACACGUAUUUACAACAUGUCCU-5' | (SEQ ID NO: 722) |
| LDHA-m1695 Target: | 5'-TATCTTGTGCATAAATGTTGTACAGGA-3' | (SEQ ID NO: 770) |

TABLE 8-continued

Selected Mouse Anti-Lactate Dehydrogenase DsiRNAs, Unmodified Duplexes (Asymmetrics)

|  |  |  |
|---|---|---|
|  | 5'-UUGUGCAUAAAUGUUGUACAGGAUA-3' | (SEQ ID NO: 819) |
|  | 3'-AGAACACGUAUUUACAACAUGUCCUAU-5' | (SEQ ID NO: 723) |
| LDHA-m1697 Target: | 5'-TCTTGTGCATAAATGTTGTACAGGATA-3' | (SEQ ID NO: 771) |
|  | 5'-UGUGCAUAAAUGUUGUACAGGAUAU-3' | (SEQ ID NO: 820) |
|  | 3'-GAACACGUAUUUACAACAUGUCCUAUA-5' | (SEQ ID NO: 724) |
| LDHA-m1698 Target: | 5'-CTTGTGCATAAATGTTGTACAGGATAT-3' | (SEQ ID NO: 772) |
|  | 5'-GUGCAUAAAUGUUGUACAGGAUAUU-3' | (SEQ ID NO: 821) |
|  | 3'-AACACGUAUUUACAACAUGUCCUAUAA-5' | (SEQ ID NO: 725) |
| LDHA-m1699 Target: | 5'-TTGTGCATAAATGTTGTACAGGATATT-3' | (SEQ ID NO: 773) |
|  | 5'-UGCAUAAAUGUUGUACAGGAUAUUU-3' | (SEQ ID NO: 822) |
|  | 3'-ACACGUAUUUACAACAUGUCCUAUAAA-5' | (SEQ ID NO: 726) |
| LDHA-m1700 Target: | 5'-TGTGCATAAATGTTGTACAGGATATTT-3' | (SEQ ID NO: 774) |
|  | 5'-GCAUAAAUGUUGUACAGGAUAUUUU-3' | (SEQ ID NO: 823) |
|  | 3'-CACGUAUUUACAACAUGUCCUAUAAAA-5' | (SEQ ID NO: 727) |
| LDHA-m1701 Target: | 5'-GTGCATAAATGTTGTACAGGATATTTT-3' | (SEQ ID NO: 775) |
|  | 5'-CAUAAAUGUUGUACAGGAUAUUUUA-3' | (SEQ ID NO: 824) |
|  | 3'-ACGUAUUUACAACAUGUCCUAUAAAAU-5' | (SEQ ID NO: 728) |
| LDHA-m1702 Target: | 5'-TGCATAAATGTTGTACAGGATATTTTA-3' | (SEQ ID NO: 776) |
|  | 5'-AUAAAUGUUGUACAGGAUAUUUUAU-3' | (SEQ ID NO: 825) |
|  | 3'-CGUAUUUACAACAUGUCCUAUAAAAUA-5' | (SEQ ID NO: 729) |
| LDHA-m1703 Target: | 5'-GCATAAATGTTGTACAGGATATTTTAT-3' | (SEQ ID NO: 777) |
|  | 5'-UAAAUGUUGUACAGGAUAUUUUAUA-3' | (SEQ ID NO: 826) |
|  | 3'-GUAUUUACAACAUGUCCUAUAAAAUAU-5' | (SEQ ID NO: 730) |
| LDHA-m1704 Target: | 5'-CATAAATGTTGTACAGGATATTTTATA-3' | (SEQ ID NO: 778) |
|  | 5'-AAAUGUUGUACAGGAUAUUUUAUAU-3' | (SEQ ID NO: 827) |
|  | 3'-UAUUUACAACAUGUCCUAUAAAAUAUA-5' | (SEQ ID NO: 731) |
| LDHA-m1705 Target: | 5'-ATAAATGTTGTACAGGATATTTTATAT-3' | (SEQ ID NO: 779) |
|  | 5'-AAUGUUGUACAGGAUAUUUUAUAUA-3' | (SEQ ID NO: 828) |
|  | 3'-AUUUACAACAUGUCCUAUAAAAUAUAU-5' | (SEQ ID NO: 732) |
| LDHA-m1706 Target: | 5'-TAAATGTTGTACAGGATATTTTATATA-3' | (SEQ ID NO: 780) |
|  | 5'-AUGUUGUACAGGAUAUUUUAUAUAU-3' | (SEQ ID NO: 829) |
|  | 3'-UUUACAACAUGUCCUAUAAAAUAUAUA-5' | (SEQ ID NO: 733) |
| LDHA-m1707 Target: | 5'-AAATGTTGTACAGGATATTTTATATAT-3' | (SEQ ID NO: 781) |
|  | 5'-UGUUGUACAGGAUAUUUUAUAUAUU-3' | (SEQ ID NO: 830) |
|  | 3'-UUACAACAUGUCCUAUAAAAUAUAUAA-5' | (SEQ ID NO: 734) |
| LDHA-m1708 Target: | 5'-AATGTTGTACAGGATATTTTATATATT-3' | (SEQ ID NO: 782) |
|  | 5'-GUUGUACAGGAUAUUUUAUAUAUUA-3' | (SEQ ID NO: 831) |
|  | 3'-UACAACAUGUCCUAUAAAAUAUAUAAU-5' | (SEQ ID NO: 735) |
| LDHA-m1709 Target: | 5'-ATGTTGTACAGGATATTTTATATATTA-3' | (SEQ ID NO: 783) |
|  | 5'-UUGUACAGGAUAUUUUAUAUAUUAU-3' | (SEQ ID NO: 832) |
|  | 3'-ACAACAUGUCCUAUAAAAUAUAUAAUA-5' | (SEQ ID NO: 736) |
| LDHA-m1710 Target: | 5'-TGTTGTACAGGATATTTTATATATTAT-3' | (SEQ ID NO: 784) |
|  | 5'-GUCUGUAGUGUGCAUUGCAAUAUUA-3' | (SEQ ID NO: 833) |
|  | 3'-CACAGACAUCACACGUAACGUUAUAAU-5' | (SEQ ID NO: 737) |
| LDHA-m1739 Target: | 5'-GTGTCTGTAGTGTGCATTGCAATATTA-3' | (SEQ ID NO: 785) |
|  | 5'-GUAGUGUGCAUUGCAAUAUUAUGUG-3' | (SEQ ID NO: 834) |
|  | 3'-GACAUCACACGUAACGUUAUAAUACAC-5' | (SEQ ID NO: 738) |
| LDHA-m1743 Target: | 5'-CTGTAGTGTGCATTGCAATATTATGTG-3' | (SEQ ID NO: 786) |
|  | 5'-UAGUGUGCAUUGCAAUAUUAUGUGA-3' | (SEQ ID NO: 835) |
|  | 3'-ACAUCACACGUAACGUUAUAAUACACU-5' | (SEQ ID NO: 739) |
| LDHA-m1744 Target: | 5'-TGTAGTGTGCATTGCAATATTATGTGA-3' | (SEQ ID NO: 787) |
|  | 5'-GUGUGCAUUGCAAUAUUAUGUGAGA-3' | (SEQ ID NO: 836) |
|  | 3'-AUCACACGUAACGUUAUAAUACACUCU-5' | (SEQ ID NO: 740) |
| LDHA-m1746 Target: | 5'-TAGTGTGCATTGCAATATTATGTGAGA-3' | (SEQ ID NO: 788) |
|  | 5'-CAUUGCAAUAUUAUGUGAGAUGUAA-3' | (SEQ ID NO: 837) |
|  | 3'-ACGUAACGUUAUAAUACACUCUACAUU-5' | (SEQ ID NO: 741) |
| LDHA-m1751 Target: | 5'-TGCATTGCAATATTATGTGAGATGTAA-3' | (SEQ ID NO: 789) |

TABLE 8-continued

Selected Mouse Anti-Lactate Dehydrogenase DsiRNAs, Unmodified Duplexes (Asymmetrics)

```
                  5'-AUUGCAAUAUUAUGUGAGAUGUAAG-3'     (SEQ ID NO: 838)
                  3'-CGUAACGUUAUAAUACACUCUACAUUC-5'   (SEQ ID NO: 742)
LDHA-m1752 Target:5'-GCATTGCAATATTATGTGAGATGTAAG-3'   (SEQ ID NO: 790)

5'-GCAAUAUUAUGUGAGAUGUAAGAUC-3'     (SEQ ID NO: 839)
                  3'-AACGUUAUAAUACACUCUACAUUCUAG-5'   (SEQ ID NO: 743)
LDHA-m1755 Target:5'-TTGCAATATTATGTGAGATGTAAGATC-3'   (SEQ ID NO: 791)

5'-CAAUAUUAUGUGAGAUGUAAGAUCU-3'     (SEQ ID NO: 840)
                  3'-ACGUUAUAAUACACUCUACAUUCUAGA-5'   (SEQ ID NO: 744)
LDHA-m1756 Target:5'-TGCAATATTATGTGAGATGTAAGATCT-3'   (SEQ ID NO: 792)
```

TABLE 9

DsiRNA Target Sequences (21mers) in Mouse Lactate Dehydrogenase mRNA

```
LDHA-m367  21 nt Target:  5'-CUCAAGGACCAGCUGAUUGUG-3'  (SEQ ID NO: 841)
LDHA-m368  21 nt Target:  5'-UCAAGGACCAGCUGAUUGUGA-3'  (SEQ ID NO: 842)
LDHA-m372  21 nt Target:  5'-GGACCAGCUGAUUGUGAAUCU-3'  (SEQ ID NO: 843)
LDHA-m376  21 nt Target:  5'-CAGCUGAUUGUGAAUCUUCUU-3'  (SEQ ID NO: 844)
LDHA-m456  21 nt Target:  5'-GGCUUGUGCCAUCAGUAUCUU-3'  (SEQ ID NO: 845)
LDHA-m501  21 nt Target:  5'-UGCCCUUGUUGACGUCAUGGA-3'  (SEQ ID NO: 846)
LDHA-m506  21 nt Target:  5'-UUGUUGACGUCAUGGAAGACA-3'  (SEQ ID NO: 847)
LDHA-m507  21 nt Target:  5'-UGUUGACGUCAUGGAAGACAA-3'  (SEQ ID NO: 848)
LDHA-m584  21 nt Target:  5'-AAAUUGUCUCCAGCAAAGACU-3'  (SEQ ID NO: 849)
LDHA-m689  21 nt Target:  5'-AGCGAAACGUGAACAUCUUCA-3'  (SEQ ID NO: 850)
LDHA-m694  21 nt Target:  5'-AACGUGAACAUCUUCAAGUUC-3'  (SEQ ID NO: 851)
LDHA-m695  21 nt Target:  5'-ACGUGAACAUCUUCAAGUUCA-3'  (SEQ ID NO: 852)
LDHA-m823  21 nt Target:  5'-AACCGAGUAAUUGGAAGUGGU-3'  (SEQ ID NO: 853)
LDHA-m1071 21 nt Target:  5'-CUACGAGGUGAUCAAGCUGAA-3'  (SEQ ID NO: 854)
LDHA-m1133 21 nt Target:  5'-UGGCUGAGAGCAUAAUGAAGA-3'  (SEQ ID NO: 855)
LDHA-m1183 21 nt Target:  5'-AUGAUUAAGGGUCUCUAUGGA-3'  (SEQ ID NO: 856)
LDHA-m1245 21 nt Target:  5'-ACAAAAUGGAAUCUCGGAUGU-3'  (SEQ ID NO: 857)
LDHA-m1250 21 nt Target:  5'-AUGGAAUCUCGGAUGUUGUGA-3'  (SEQ ID NO: 858)
LDHA-m1257 21 nt Target:  5'-CUCGGAUGUUGUGAAGGUGAC-3'  (SEQ ID NO: 859)
LDHA-m1687 21 nt Target:  5'-AUGAUGCAUAUCUUGUGCAUA-3'  (SEQ ID NO: 860)
LDHA-m1688 21 nt Target:  5'-UGAUGCAUAUCUUGUGCAUAA-3'  (SEQ ID NO: 861)
LDHA-m1690 21 nt Target:  5'-AUGCAUAUCUUGUGCAUAAAU-3'  (SEQ ID NO: 862)
LDHA-m1691 21 nt Target:  5'-UGCAUAUCUUGUGCAUAAAUG-3'  (SEQ ID NO: 863)
LDHA-m1692 21 nt Target:  5'-GCAUAUCUUGUGCAUAAAUGU-3'  (SEQ ID NO: 864)
LDHA-m1694 21 nt Target:  5'-AUAUCUUGUGCAUAAAUGUUG-3'  (SEQ ID NO: 865)
LDHA-m1695 21 nt Target:  5'-UAUCUUGUGCAUAAAUGUUGU-3'  (SEQ ID NO: 866)
LDHA-m1697 21 nt Target:  5'-UCUUGUGCAUAAAUGUUGUAC-3'  (SEQ ID NO: 867)
LDHA-m1698 21 nt Target:  5'-CUUGUGCAUAAAUGUUGUACA-3'  (SEQ ID NO: 868)
LDHA-m1699 21 nt Target:  5'-UUGUGCAUAAAUGUUGUACAG-3'  (SEQ ID NO: 869)
```

TABLE 9-continued

DsiRNA Target Sequences (21mers) in Mouse Lactate Dehydrogenase mRNA

LDHA-m1700 21 nt Target: 5'-UGUGCAUAAAUGUUGUACAGG-3' (SEQ ID NO: 870)

LDHA-m1701 21 nt Target: 5'-GUGCAUAAAUGUUGUACAGGA-3' (SEQ ID NO: 871)

LDHA-m1702 21 nt Target: 5'-UGCAUAAAUGUUGUACAGGAU-3' (SEQ ID NO: 872)

LDHA-m1703 21 nt Target: 5'-GCAUAAAUGUUGUACAGGAUA-3' (SEQ ID NO: 873)

LDHA-m1704 21 nt Target: 5'-CAUAAAUGUUGUACAGGAUAU-3' (SEQ ID NO: 874)

LDHA-m1705 21 nt Target: 5'-AUAAAUGUUGUACAGGAUAUU-3' (SEQ ID NO: 875)

LDHA-m1706 21 nt Target: 5'-UAAAUGUUGUACAGGAUAUUU-3' (SEQ ID NO: 876)

LDHA-m1707 21 nt Target: 5'-AAAUGUUGUACAGGAUAUUUU-3' (SEQ ID NO: 877)

LDHA-m1708 21 nt Target: 5'-AAUGUUGUACAGGAUAUUUUA-3' (SEQ ID NO: 878)

LDHA-m1709 21 nt Target: 5'-AUGUUGUACAGGAUAUUUUAU-3' (SEQ ID NO: 879)

LDHA-m1710 21 nt Target: 5'-UGUUGUACAGGAUAUUUUAUA-3' (SEQ ID NO: 880)

LDHA-m1739 21 nt Target: 5'-GUGUCUGUAGUGUGCAUUGCA-3' (SEQ ID NO: 881)

LDHA-m1743 21 nt Target: 5'-CUGUAGUGUGCAUUGCAAUAU-3' (SEQ ID NO: 882)

LDHA-m1744 21 nt Target: 5'-UGUAGUGUGCAUUGCAAUAUU-3' (SEQ ID NO: 883)

LDHA-m1746 21 nt Target: 5'-UAGUGUGCAUUGCAAUAUUAU-3' (SEQ ID NO: 884)

LDHA-m1751 21 nt Target: 5'-UGCAUUGCAAUAUUAUGUGAG-3' (SEQ ID NO: 885)

LDHA-m1752 21 nt Target: 5'-GCAUUGCAAUAUUAUGUGAGA-3' (SEQ ID NO: 886)

LDHA-m1755 21 nt Target: 5'-UUGCAAUAUUAUGUGAGAUGU-3' (SEQ ID NO: 887)

LDHA-m1756 21 nt Target: 5'-UGCAAUAUUAUGUGAGAUGUA-3' (SEQ ID NO: 888)

TABLE 10

Selected Mouse Anti-Lactate Dehydrogenase "Blunt/Blunt" DsiRNAs

```
               5'-CUCAAGGACCAGCUGAUUGUGAAUCUU-3'  (SEQ ID NO: 889)
               3'-GAGUUCCUGGUCGACUAACACUUAGAA-5'  (SEQ ID NO: 697)
LDHA-m367 Target: 5'-CTCAAGGACCAGCTGATTGTGAATCTT-3'  (SEQ ID NO: 745)

5'-UCAAGGACCAGCUGAUUGUGAAUCUUC-3'  (SEQ ID NO: 890)
               3'-AGUUCCUGGUCGACUAACACUUAGAAG-5'  (SEQ ID NO: 698)
LDHA-m368 Target: 5'-TCAAGGACCAGCTGATTGTGAATCTTC-3'  (SEQ ID NO: 746)

5'-GGACCAGCUGAUUGUGAAUCUUCUUAA-3'  (SEQ ID NO: 891)
               3'-CCUGGUCGACUAACACUUAGAAGAAUU-5'  (SEQ ID NO: 699)
LDHA-m372 Target: 5'-GGACCAGCTGATTGTGAATCTTCTTAA-3'  (SEQ ID NO: 747)

5'-CAGCUGAUUGUGAAUCUUCUUAAGGAA-3'  (SEQ ID NO: 892)
               3'-GUCGACUAACACUUAGAAGAAUUCCUU-5'  (SEQ ID NO: 700)
LDHA-m376 Target: 5'-CAGCTGATTGTGAATCTTCTTAAGGAA-3'  (SEQ ID NO: 748)

5'-GGCUUGUGCCAUCAGUAUCUUAAUGAA-3'  (SEQ ID NO: 893)
               3'-CCGAACACGGUAGUCAUAGAAUUACUU-5'  (SEQ ID NO: 701)
LDHA-m456 Target: 5'-GGCTTGTGCCATCAGTATCTTAATGAA-3'  (SEQ ID NO: 749)

5'-UGCCCUUGUUGACGUCAUGGAAGACAA-3'  (SEQ ID NO: 894)
               3'-ACGGGAACAACUGCAGUACCUUCUGUU-5'  (SEQ ID NO: 702)
LDHA-m501 Target: 5'-TGCCCTTGTTGACGTCATGGAAGACAA-3'  (SEQ ID NO: 750)

5'-UUGUUGACGUCAUGGAAGACAAACUCA-3'  (SEQ ID NO: 895)
               3'-AACAACUGCAGUACCUUCUGUUUGAGU-5'  (SEQ ID NO: 703)
LDHA-m506 Target: 5'-TTGTTGACGTCATGGAAGACAAACTCA-3'  (SEQ ID NO: 751)

5'-UGUUGACGUCAUGGAAGACAAACUCAA-3'  (SEQ ID NO: 896)
               3'-ACAACUGCAGUACCUUCUGUUUGAGUU-5'  (SEQ ID NO: 704)
LDHA-m507 Target: 5'-TGTTGACGTCATGGAAGACAAACTCAA-3'  (SEQ ID NO: 752)
```

TABLE 10-continued

Selected Mouse Anti-Lactate Dehydrogenase "Blunt/Blunt" DsiRNAs

|  |  |  |
|---|---|---|
|  | 5'-AAAUUGUCUCCAGCAAAGACUACUGUG-3' | (SEQ ID NO: 897) |
|  | 3'-UUUAACAGAGGUCGUUUCUGAUGACAC-5' | (SEQ ID NO: 705) |
| LDHA-m584 Target: | 5'-AAATTGTCTCCAGCAAAGACTACTGTG-3' | (SEQ ID NO: 753) |
|  | 5'-AGCGAAACGUGAACAUCUUCAAGUUCA-3' | (SEQ ID NO: 898) |
|  | 3'-UCGCUUUGCACUUGUAGAAGUUCAAGU-5' | (SEQ ID NO: 706) |
| LDHA-m689 Target: | 5'-AGCGAAACGTGAACATCTTCAAGTTCA-3' | (SEQ ID NO: 754) |
|  | 5'-AACGUGAACAUCUUCAAGUUCAUCAUU-3' | (SEQ ID NO: 899) |
|  | 3'-UUGCACUUGUAGAAGUUCAAGUAGUAA-5' | (SEQ ID NO: 707) |
| LDHA-m694 Target: | 5'-AACGTGAACATCTTCAAGTTCATCATT-3' | (SEQ ID NO: 755) |
|  | 5'-ACGUGAACAUCUUCAAGUUCAUCAUUC-3' | (SEQ ID NO: 900) |
|  | 3'-UGCACUUGUAGAAGUUCAAGUAGUAAG-5' | (SEQ ID NO: 708) |
| LDHA-m695 Target: | 5'-ACGTGAACATCTTCAAGTTCATCATTC-3' | (SEQ ID NO: 756) |
|  | 5'-AACCGAGUAAUUGGAAGUGGUUGCAAU-3' | (SEQ ID NO: 901) |
|  | 3'-UUGGCUCAUUAACCUUCACCAACGUUA-5' | (SEQ ID NO: 709) |
| LDHA-m823 Target: | 5'-AACCGAGTAATTGGAAGTGGTTGCAAT-3' | (SEQ ID NO: 757) |
|  | 5'-CUACGAGGUGAUCAAGCUGAAAGGUUA-3' | (SEQ ID NO: 902) |
|  | 3'-GAUGCUCCACUAGUUCGACUUUCCAAU-5' | (SEQ ID NO: 710) |
| LDHA-m1071 Target: | 5'-CTACGAGGTGATCAAGCTGAAAGGTTA-3' | (SEQ ID NO: 758) |
|  | 5'-UGGCUGAGAGCAUAAUGAAGAACCUUA-3' | (SEQ ID NO: 903) |
|  | 3'-ACCGACUCUCGUAUUACUUCUUGGAAU-5' | (SEQ ID NO: 711) |
| LDHA-m1133 Target: | 5'-TGGCTGAGAGCATAATGAAGAACCTTA-3' | (SEQ ID NO: 759) |
|  | 5'-AUGAUUAAGGGUCUCUAUGGAAUCAAU-3' | (SEQ ID NO: 904) |
|  | 3'-UACUAAUUCCCAGAGAUACCUUAGUUA-5' | (SEQ ID NO: 712) |
| LDHA-m1183 Target: | 5'-ATGATTAAGGGTCTCTATGGAATCAAT-3' | (SEQ ID NO: 760) |
|  | 5'-ACAAAAUGGAAUCUCGGAUGUUGUGAA-3' | (SEQ ID NO: 905) |
|  | 3'-UGUUUUACCUUAGAGCCUACAACACUU-5' | (SEQ ID NO: 713) |
| LDHA-m1245 Target: | 5'-ACAAAATGGAATCTCGGATGTTGTGAA-3' | (SEQ ID NO: 761) |
|  | 5'-AUGGAAUCUCGGAUGUUGUGAAGGUGA-3' | (SEQ ID NO: 906) |
|  | 3'-UACCUUAGAGCCUACAACACUUCCACU-5' | (SEQ ID NO: 714) |
| LDHA-m1250 Target: | 5'-ATGGAATCTCGGATGTTGTGAAGGTGA-3' | (SEQ ID NO: 762) |
|  | 5'-CUCGGAUGUUGUGAAGGUGACACUGAC-3' | (SEQ ID NO: 907) |
|  | 3'-GAGCCUACAACACUUCCACUGUGACUG-5' | (SEQ ID NO: 715) |
| LDHA-m1257 Target: | 5'-CTCGGATGTTGTGAAGGTGACACTGAC-3' | (SEQ ID NO: 763) |
|  | 5'-AUGAUGCAUAUCUUGUGCAUAAAUGUU-3' | (SEQ ID NO: 908) |
|  | 3'-UACUACGUAUAGAACACGUAUUUACAA-5' | (SEQ ID NO: 716) |
| LDHA-m1687 Target: | 5'-ATGATGCATATCTTGTGCATAAATGTT-3' | (SEQ ID NO: 764) |
|  | 5'-UGAUGCAUAUCUUGUGCAUAAAUGUUG-3' | (SEQ ID NO: 909) |
|  | 3'-ACUACGUAUAGAACACGUAUUUACAAC-5' | (SEQ ID NO: 717) |
| LDHA-m1688 Target: | 5'-TGATGCATATCTTGTGCATAAATGTTG-3' | (SEQ ID NO: 765) |
|  | 5'-AUGCAUAUCUUGUGCAUAAAUGUUGUA-3' | (SEQ ID NO: 910) |
|  | 3'-UACGUAUAGAACACGUAUUUACAACAU-5' | (SEQ ID NO: 718) |
| LDHA-m1690 Target: | 5'-ATGCATATCTTGTGCATAAATGTTGTA-3' | (SEQ ID NO: 766) |
|  | 5'-UGCAUAUCUUGUGCAUAAAUGUUGUAC-3' | (SEQ ID NO: 911) |
|  | 3'-ACGUAUAGAACACGUAUUUACAACAUG-5' | (SEQ ID NO: 719) |
| LDHA-m1691 Target: | 5'-TGCATATCTTGTGCATAAATGTTGTAC-3' | (SEQ ID NO: 767) |
|  | 5'-GCAUAUCUUGUGCAUAAAUGUUGUACA-3' | (SEQ ID NO: 912) |
|  | 3'-CGUAUAGAACACGUAUUUACAACAUGU-5' | (SEQ ID NO: 720) |
| LDHA-m1692 Target: | 5'-GCATATCTTGTGCATAAATGTTGTACA-3' | (SEQ ID NO: 768) |
|  | 5'-AUAUCUUGUGCAUAAAUGUUGUACAGG-3' | (SEQ ID NO: 913) |
|  | 3'-UAUAGAACACGUAUUUACAACAUGUCC-5' | (SEQ ID NO: 721) |
| LDHA-m1694 Target: | 5'-ATATCTTGTGCATAAATGTTGTACAGG-3' | (SEQ ID NO: 769) |
|  | 5'-UAUCUUGUGCAUAAAUGUUGUACAGGA-3' | (SEQ ID NO: 914) |
|  | 3'-AUAGAACACGUAUUUACAACAUGUCCU-5' | (SEQ ID NO: 722) |
| LDHA-m1695 Target: | 5'-TATCTTGTGCATAAATGTTGTACAGGA-3' | (SEQ ID NO: 770) |
|  | 5'-UCUUGUGCAUAAAUGUUGUACAGGAUA-3' | (SEQ ID NO: 915) |
|  | 3'-AGAACACGUAUUUACAACAUGUCCUAU-5' | (SEQ ID NO: 723) |
| LDHA-m1697 Target: | 5'-TCTTGTGCATAAATGTTGTACAGGATA-3' | (SEQ ID NO: 771) |

TABLE 10-continued

Selected Mouse Anti-Lactate Dehydrogenase "Blunt/Blunt" DsiRNAs

```
                     5'-CUUGUGCAUAAAUGUUGUACAGGAUAU-3'    (SEQ ID NO: 916)
                     3'-GAACACGUAUUUACAACAUGUCCUAUA-5'    (SEQ ID NO: 724)
LDHA-m1698 Target: 5'-CTTGTGCATAAATGTTGTACAGGATAT-3'      (SEQ ID NO: 772)

5'-UUGUGCAUAAAUGUUGUACAGGAUAUU-3'    (SEQ ID NO: 917)
                     3'-AACACGUAUUUACAACAUGUCCUAUAA-5'    (SEQ ID NO: 725)
LDHA-m1699 Target: 5'-TTGTGCATAAATGTTGTACAGGATATT-3'      (SEQ ID NO: 773)

5'-UGUGCAUAAAUGUUGUACAGGAUAUUU-3'    (SEQ ID NO: 918)
                     3'-ACACGUAUUUACAACAUGUCCUAUAAA-5'    (SEQ ID NO: 726)
LDHA-m1700 Target: 5'-TGTGCATAAATGTTGTACAGGATATTT-3'      (SEQ ID NO: 774)

5'-GUGCAUAAAUGUUGUACAGGAUAUUUU-3'    (SEQ ID NO: 919)
                     3'-CACGUAUUUACAACAUGUCCUAUAAAA-5'    (SEQ ID NO: 727)
LDHA-m1701 Target: 5'-GTGCATAAATGTTGTACAGGATATTTT-3'      (SEQ ID NO: 775)

5'-UGCAUAAAUGUUGUACAGGAUAUUUUA-3'    (SEQ ID NO: 920)
                     3'-ACGUAUUUACAACAUGUCCUAUAAAAU-5'    (SEQ ID NO: 728)
LDHA-m1702 Target: 5'-TGCATAAATGTTGTACAGGATATTTTA-3'      (SEQ ID NO: 776)

5'-GCAUAAAUGUUGUACAGGAUAUUUUAU-3'    (SEQ ID NO: 921)
                     3'-CGUAUUUACAACAUGUCCUAUAAAAUA-5'    (SEQ ID NO: 729)
LDHA-m1703 Target: 5'-GCATAAATGTTGTACAGGATATTTTAT-3'      (SEQ ID NO: 777)

5'-CAUAAAUGUUGUACAGGAUAUUUUAUA-3'    (SEQ ID NO: 922)
                     3'-GUAUUUACAACAUGUCCUAUAAAAUAU-5'    (SEQ ID NO: 730)
LDHA-m1704 Target: 5'-CATAAATGTTGTACAGGATATTTTATA-3'      (SEQ ID NO: 778)

5'-AUAAAUGUUGUACAGGAUAUUUUAUAU-3'    (SEQ ID NO: 923)
                     3'-UAUUUACAACAUGUCCUAUAAAAUAUA-5'    (SEQ ID NO: 731)
LDHA-m1705 Target: 5'-ATAAATGTTGTACAGGATATTTTATAT-3'      (SEQ ID NO: 779)

5'-UAAAUGUUGUACAGGAUAUUUUAUAUA-3'    (SEQ ID NO: 924)
                     3'-AUUUACAACAUGUCCUAUAAAAUAUAU-5'    (SEQ ID NO: 732)
LDHA-m1706 Target: 5'-TAAATGTTGTACAGGATATTTTATATA-3'      (SEQ ID NO: 780)

5'-AAAUGUUGUACAGGAUAUUUUAUAUAU-3'    (SEQ ID NO: 925)
                     3'-UUUACAACAUGUCCUAUAAAAUAUAUA-5'    (SEQ ID NO: 733)
LDHA-m1707 Target: 5'-AAATGTTGTACAGGATATTTTATATAT-3'      (SEQ ID NO: 781)

5'-AAUGUUGUACAGGAUAUUUUAUAUAUU-3'    (SEQ ID NO: 926)
                     3'-UUACAACAUGUCCUAUAAAAUAUAUAA-5'    (SEQ ID NO: 734)
LDHA-m1708 Target: 5'-AATGTTGTACAGGATATTTTATATATT-3'      (SEQ ID NO: 782)

5'-AUGUUGUACAGGAUAUUUUAUAUAUUA-3'    (SEQ ID NO: 927)
                     3'-UACAACAUGUCCUAUAAAAUAUAUAAU-5'    (SEQ ID NO: 735)
LDHA-m1709 Target: 5'-ATGTTGTACAGGATATTTTATATATTA-3'      (SEQ ID NO: 783)

5'-UGUUGUACAGGAUAUUUUAUAUAUUAU-3'    (SEQ ID NO: 928)
                     3'-ACAACAUGUCCUAUAAAAUAUAUAAUA-5'    (SEQ ID NO: 736)
LDHA-m1710 Target: 5'-TGTTGTACAGGATATTTTATATATTAT-3'      (SEQ ID NO: 784)

5'-GUGUCUGUAGUGUGCAUUGCAAUAUUA-3'    (SEQ ID NO: 929)
                     3'-CACAGACAUCACACGUAACGUUAUAAU-5'    (SEQ ID NO: 737)
LDHA-m1739 Target: 5'-GTGTCTGTAGTGTGCATTGCAATATTA-3'      (SEQ ID NO: 785)

5'-CUGUAGUGUGCAUUGCAAUAUUAUGUG-3'    (SEQ ID NO: 930)
                     3'-GACAUCACACGUAACGUUAUAAUACAC-5'    (SEQ ID NO: 738)
LDHA-m1743 Target: 5'-CTGTAGTGTGCATTGCAATATTATGTG-3'      (SEQ ID NO: 786)

5'-UGUAGUGUGCAUUGCAAUAUUAUGUGA-3'    (SEQ ID NO: 931)
                     3'-ACAUCACACGUAACGUUAUAAUACACU-5'    (SEQ ID NO: 739)
LDHA-m1744 Target: 5'-TGTAGTGTGCATTGCAATATTATGTGA-3'      (SEQ ID NO: 787)

5'-UAGUGUGCAUUGCAAUAUUAUGUGAGA-3'    (SEQ ID NO: 932)
                     3'-AUCACACGUAACGUUAUAAUACACUCU-5'    (SEQ ID NO: 740)
LDHA-m1746 Target: 5'-TAGTGTGCATTGCAATATTATGTGAGA-3'      (SEQ ID NO: 788)

5'-UGCAUUGCAAUAUUAUGUGAGAUGUAA-3'    (SEQ ID NO: 933)
                     3'-ACGUAACGUUAUAAUACACUCUACAUU-5'    (SEQ ID NO: 741)
LDHA-m1751 Target: 5'-TGCATTGCAATATTATGTGAGATGTAA-3'      (SEQ ID NO: 789)

5'-GCAUUGCAAUAUUAUGUGAGAUGUAAG-3'    (SEQ ID NO: 934)
                     3'-CGUAACGUUAUAAUACACUCUACAUUC-5'    (SEQ ID NO: 742)
LDHA-m1752 Target: 5'-GCATTGCAATATTATGTGAGATGTAAG-3'      (SEQ ID NO: 790)
```

TABLE 10-continued

Selected Mouse Anti-Lactate Dehydrogenase "Blunt/Blunt" DsiRNAs

```
                 5'-UUGCAAUAUUAUGUGAGAUGUAAGAUC-3'  (SEQ ID NO: 935)
                 3'-AACGUUAUAAUACACUCUACAUUCUAG-5'  (SEQ ID NO: 743)
LDHA-m1755 Target:5'-TTGCAATATTATGTGAGATGTAAGATC-3' (SEQ ID NO: 791)

5'-UGCAAUAUUAUGUGAGAUGUAAGAUCU-3'  (SEQ ID NO: 936)
                 3'-ACGUUAUAAUACACUCUACAUUCUAGA-5'  (SEQ ID NO: 744)
LDHA-m1756 Target:5'-TGCAATATTATGTGAGATGTAAGATCT-3' (SEQ ID NO: 792)
```

TABLE 11

DsiRNA Component 19 Nucleotide Target Sequences in Mouse Lactate Dehydrogenase mRNA

| | | |
|---|---|---|
| LDHA-m367 19 nt Target #1: | 5'-CAAGGACCAGCUGAUUGUG-3' | (SEQ ID NO: 937) |
| LDHA-m367 19 nt Target #2: | 5'-UCAAGGACCAGCUGAUUGU-3' | (SEQ ID NO: 985) |
| LDHA-m367 19 nt Target #3: | 5'-CUCAAGGACCAGCUGAUUG-3' | (SEQ ID NO: 1033) |
| LDHA-m368 19 nt Target #1: | 5'-AAGGACCAGCUGAUUGUGA-3' | (SEQ ID NO: 938) |
| LDHA-m368 19 nt Target #2: | 5'-CAAGGACCAGCUGAUUGUG-3' | (SEQ ID NO: 986) |
| LDHA-m368 19 nt Target #3: | 5'-UCAAGGACCAGCUGAUUGU-3' | (SEQ ID NO: 1034) |
| LDHA-m372 19 nt Target #1: | 5'-ACCAGCUGAUUGUGAAUCU-3' | (SEQ ID NO: 939) |
| LDHA-m372 19 nt Target #2: | 5'-GACCAGCUGAUUGUGAAUC-3' | (SEQ ID NO: 987) |
| LDHA-m372 19 nt Target #3: | 5'-GGACCAGCUGAUUGUGAAU-3' | (SEQ ID NO: 1035) |
| LDHA-m376 19 nt Target #1: | 5'-GCUGAUUGUGAAUCUUCUU-3' | (SEQ ID NO: 940) |
| LDHA-m376 19 nt Target #2: | 5'-AGCUGAUUGUGAAUCUUCU-3' | (SEQ ID NO: 988) |
| LDHA-m376 19 nt Target #3: | 5'-CAGCUGAUUGUGAAUCUUC-3' | (SEQ ID NO: 1036) |
| LDHA-m456 19 nt Target #1: | 5'-CUUGUGCCAUCAGUAUCUU-3' | (SEQ ID NO: 941) |
| LDHA-m456 19 nt Target #2: | 5'-GCUUGUGCCAUCAGUAUCU-3' | (SEQ ID NO: 989) |
| LDHA-m456 19 nt Target #3: | 5'-GGCUUGUGCCAUCAGUAUC-3' | (SEQ ID NO: 1037) |
| LDHA-m501 19 nt Target #1: | 5'-CCCUUGUUGACGUCAUGGA-3' | (SEQ ID NO: 942) |
| LDHA-m501 19 nt Target #2: | 5'-GCCCUUGUUGACGUCAUGG-3' | (SEQ ID NO: 990) |
| LDHA-m501 19 nt Target #3: | 5'-UGCCCUUGUUGACGUCAUG-3' | (SEQ ID NO: 1038) |
| LDHA-m506 19 nt Target #1: | 5'-GUUGACGUCAUGGAAGACA-3' | (SEQ ID NO: 943) |
| LDHA-m506 19 nt Target #2: | 5'-UGUUGACGUCAUGGAAGAC-3' | (SEQ ID NO: 991) |
| LDHA-m506 19 nt Target #3: | 5'-UUGUUGACGUCAUGGAAGA-3' | (SEQ ID NO: 1039) |
| LDHA-m507 19 nt Target #1: | 5'-UUGACGUCAUGGAAGACAA-3' | (SEQ ID NO: 944) |
| LDHA-m507 19 nt Target #2: | 5'-GUUGACGUCAUGGAAGACA-3' | (SEQ ID NO: 992) |
| LDHA-m507 19 nt Target #3: | 5'-UGUUGACGUCAUGGAAGAC-3' | (SEQ ID NO: 1040) |
| LDHA-m584 19 nt Target #1: | 5'-AUUGUCUCCAGCAAAGACU-3' | (SEQ ID NO: 945) |
| LDHA-m584 19 nt Target #2: | 5'-AAUUGUCUCCAGCAAAGAC-3' | (SEQ ID NO: 993) |
| LDHA-m584 19 nt Target #3: | 5'-AAAUUGUCUCCAGCAAAGA-3' | (SEQ ID NO: 1041) |
| LDHA-m689 19 nt Target #1: | 5'-CGAAACGUGAACAUCUUCA-3' | (SEQ ID NO: 946) |
| LDHA-m689 19 nt Target #2: | 5'-GCGAAACGUGAACAUCUUC-3' | (SEQ ID NO: 994) |
| LDHA-m689 19 nt Target #3: | 5'-AGCGAAACGUGAACAUCUU-3' | (SEQ ID NO: 1042) |
| LDHA-m694 19 nt Target #1: | 5'-CGUGAACAUCUUCAAGUUC-3' | (SEQ ID NO: 947) |

TABLE 11-continued

DsiRNA Component 19 Nucleotide Target Sequences in Mouse Lactate Dehydrogenase mRNA

| | | | |
|---|---|---|---|
| LDHA-m694 19 nt Target #2: | 5'-ACGUGAACAUCUUCAAGUU-3' | (SEQ ID NO: 995) |
| LDHA-m694 19 nt Target #3: | 5'-AACGUGAACAUCUUCAAGU-3' | (SEQ ID NO: 1043) |
| LDHA-m695 19 nt Target #1: | 5'-GUGAACAUCUUCAAGUUCA-3' | (SEQ ID NO: 948) |
| LDHA-m695 19 nt Target #2: | 5'-CGUGAACAUCUUCAAGUUC-3' | (SEQ ID NO: 996) |
| LDHA-m695 19 nt Target #3: | 5'-ACGUGAACAUCUUCAAGUU-3' | (SEQ ID NO: 1044) |
| LDHA-m823 19 nt Target #1: | 5'-CCGAGUAAUUGGAAGUGGU-3' | (SEQ ID NO: 949) |
| LDHA-m823 19 nt Target #2: | 5'-ACCGAGUAAUUGGAAGUGG-3' | (SEQ ID NO: 997) |
| LDHA-m823 19 nt Target #3: | 5'-AACCGAGUAAUUGGAAGUG-3' | (SEQ ID NO: 1045) |
| LDHA-m1071 19 nt Target #1: | 5'-ACGAGGUGAUCAAGCUGAA-3' | (SEQ ID NO: 950) |
| LDHA-m1071 19 nt Target #2: | 5'-UACGAGGUGAUCAAGCUGA-3' | (SEQ ID NO: 998) |
| LDHA-m1071 19 nt Target #3: | 5'-CUACGAGGUGAUCAAGCUG-3' | (SEQ ID NO: 1046) |
| LDHA-m1133 19 nt Target #1: | 5'-GCUGAGAGCAUAAUGAAGA-3' | (SEQ ID NO: 951) |
| LDHA-m1133 19 nt Target #2: | 5'-GGCUGAGAGCAUAAUGAAG-3' | (SEQ ID NO: 999) |
| LDHA-m1133 19 nt Target #3: | 5'-UGGCUGAGAGCAUAAUGAA-3' | (SEQ ID NO: 1047) |
| LDHA-m1183 19 nt Target #1: | 5'-GAUUAAGGGUCUCUAUGGA-3' | (SEQ ID NO: 952) |
| LDHA-m1183 19 nt Target #2: | 5'-UGAUUAAGGGUCUCUAUGG-3' | (SEQ ID NO: 1000) |
| LDHA-m1183 19 nt Target #3: | 5'-AUGAUUAAGGGUCUCUAUG-3' | (SEQ ID NO: 1048) |
| LDHA-m1245 19 nt Target #1: | 5'-AAAAUGGAAUCUCGGAUGU-3' | (SEQ ID NO: 953) |
| LDHA-m1245 19 nt Target #2: | 5'-CAAAAUGGAAUCUCGGAUG-3' | (SEQ ID NO: 1001) |
| LDHA-m1245 19 nt Target #3: | 5'-ACAAAAUGGAAUCUCGGAU-3' | (SEQ ID NO: 1049) |
| LDHA-m1250 19 nt Target #1: | 5'-GGAAUCUCGGAUGUUGUGA-3' | (SEQ ID NO: 954) |
| LDHA-m1250 19 nt Target #2: | 5'-UGGAAUCUCGGAUGUUGUG-3' | (SEQ ID NO: 1002) |
| LDHA-m1250 19 nt Target #3: | 5'-AUGGAAUCUCGGAUGUUGU-3' | (SEQ ID NO: 1050) |
| LDHA-m1257 19 nt Target #1: | 5'-CGGAUGUUGUGAAGGUGAC-3' | (SEQ ID NO: 955) |
| LDHA-m1257 19 nt Target #2: | 5'-UCGGAUGUUGUGAAGGUGA-3' | (SEQ ID NO: 1003) |
| LDHA-m1257 19 nt Target #3: | 5'-CUCGGAUGUUGUGAAGGUG-3' | (SEQ ID NO: 1051) |
| LDHA-m1687 19 nt Target #1: | 5'-GAUGCAUAUCUUGUGCAUA-3' | (SEQ ID NO: 956) |
| LDHA-m1687 19 nt Target #2: | 5'-UGAUGCAUAUCUUGUGCAU-3' | (SEQ ID NO: 1004) |
| LDHA-m1687 19 nt Target #3: | 5'-AUGAUGCAUAUCUUGUGCA-3' | (SEQ ID NO: 1052) |
| LDHA-m1688 19 nt Target #1: | 5'-AUGCAUAUCUUGUGCAUAA-3' | (SEQ ID NO: 957) |
| LDHA-m1688 19 nt Target #2: | 5'-GAUGCAUAUCUUGUGCAUA-3' | (SEQ ID NO: 1005) |
| LDHA-m1688 19 nt Target #3: | 5'-UGAUGCAUAUCUUGUGCAU-3' | (SEQ ID NO: 1053) |
| LDHA-m1690 19 nt Target #1: | 5'-GCAUAUCUUGUGCAUAAAU-3' | (SEQ ID NO: 958) |
| LDHA-m1690 19 nt Target #2: | 5'-UGCAUAUCUUGUGCAUAAA-3' | (SEQ ID NO: 1006) |
| LDHA-m1690 19 nt Target #3: | 5'-AUGCAUAUCUUGUGCAUAA-3' | (SEQ ID NO: 1054) |
| LDHA-m1691 19 nt Target #1: | 5'-CAUAUCUUGUGCAUAAAUG-3' | (SEQ ID NO: 959) |
| LDHA-m1691 19 nt Target #2: | 5'-GCAUAUCUUGUGCAUAAAU-3' | (SEQ ID NO: 1007) |
| LDHA-m1691 19 nt Target #3: | 5'-UGCAUAUCUUGUGCAUAAA-3' | (SEQ ID NO: 1055) |

TABLE 11-continued

DsiRNA Component 19 Nucleotide Target Sequences in Mouse Lactate
Dehydrogenase mRNA

| | | |
|---|---|---|
| LDHA-m1692 19 nt Target #1: | 5'-AUAUCUUGUGCAUAAAUGU-3' | (SEQ ID NO: 960) |
| LDHA-m1692 19 nt Target #2: | 5'-CAUAUCUUGUGCAUAAAUG-3' | (SEQ ID NO: 1008) |
| LDHA-m1692 19 nt Target #3: | 5'-GCAUAUCUUGUGCAUAAAU-3' | (SEQ ID NO: 1056) |
| LDHA-m1694 19 nt Target #1: | 5'-AUCUUGUGCAUAAAUGUUG-3' | (SEQ ID NO: 961) |
| LDHA-m1694 19 nt Target #2: | 5'-UAUCUUGUGCAUAAAUGUU-3' | (SEQ ID NO: 1009) |
| LDHA-m1694 19 nt Target #3: | 5'-AUAUCUUGUGCAUAAAUGU-3' | (SEQ ID NO: 1057) |
| LDHA-m1695 19 nt Target #1: | 5'-UCUUGUGCAUAAAUGUUGU-3' | (SEQ ID NO: 962) |
| LDHA-m1695 19 nt Target #2: | 5'-AUCUUGUGCAUAAAUGUUG-3' | (SEQ ID NO: 1010) |
| LDHA-m1695 19 nt Target #3: | 5'-UAUCUUGUGCAUAAAUGUU-3' | (SEQ ID NO: 1058) |
| LDHA-m1697 19 nt Target #1: | 5'-UUGUGCAUAAAUGUUGUAC-3' | (SEQ ID NO: 963) |
| LDHA-m1697 19 nt Target #2: | 5'-CUUGUGCAUAAAUGUUGUA-3' | (SEQ ID NO: 1011) |
| LDHA-m1697 19 nt Target #3: | 5'-UCUUGUGCAUAAAUGUUGU-3' | (SEQ ID NO: 1059) |
| LDHA-m1698 19 nt Target #1: | 5'-UGUGCAUAAAUGUUGUACA-3' | (SEQ ID NO: 964) |
| LDHA-m1698 19 nt Target #2: | 5'-UUGUGCAUAAAUGUUGUAC-3' | (SEQ ID NO: 1012) |
| LDHA-m1698 19 nt Target #3: | 5'-CUUGUGCAUAAAUGUUGUA-3' | (SEQ ID NO: 1060) |
| LDHA-m1699 19 nt Target #1: | 5'-GUGCAUAAAUGUUGUACAG-3' | (SEQ ID NO: 965) |
| LDHA-m1699 19 nt Target #2: | 5'-UGUGCAUAAAUGUUGUACA-3' | (SEQ ID NO: 1013) |
| LDHA-m1699 19 nt Target #3: | 5'-UUGUGCAUAAAUGUUGUAC-3' | (SEQ ID NO: 1061) |
| LDHA-m1700 19 nt Target #1: | 5'-UGCAUAAAUGUUGUACAGG-3' | (SEQ ID NO: 966) |
| LDHA-m1700 19 nt Target #2: | 5'-GUGCAUAAAUGUUGUACAG-3' | (SEQ ID NO: 1014) |
| LDHA-m1700 19 nt Target #3: | 5'-UGUGCAUAAAUGUUGUACA-3' | (SEQ ID NO: 1062) |
| LDHA-m1701 19 nt Target #1: | 5'-GCAUAAAUGUUGUACAGGA-3' | (SEQ ID NO: 967) |
| LDHA-m1701 19 nt Target #2: | 5'-UGCAUAAAUGUUGUACAGG-3' | (SEQ ID NO: 1015) |
| LDHA-m1701 19 nt Target #3: | 5'-GUGCAUAAAUGUUGUACAG-3' | (SEQ ID NO: 1063) |
| LDHA-m1702 19 nt Target #1: | 5'-CAUAAAUGUUGUACAGGAU-3' | (SEQ ID NO: 968) |
| LDHA-m1702 19 nt Target #2: | 5'-GCAUAAAUGUUGUACAGGA-3' | (SEQ ID NO: 1016) |
| LDHA-m1702 19 nt Target #3: | 5'-UGCAUAAAUGUUGUACAGG-3' | (SEQ ID NO: 1064) |
| LDHA-m1703 19 nt Target #1: | 5'-AUAAAUGUUGUACAGGAUA-3' | (SEQ ID NO: 969) |
| LDHA-m1703 19 nt Target #2: | 5'-CAUAAAUGUUGUACAGGAU-3' | (SEQ ID NO: 1017) |
| LDHA-m1703 19 nt Target #3: | 5'-GCAUAAAUGUUGUACAGGA-3' | (SEQ ID NO: 1065) |
| LDHA-m1704 19 nt Target #1: | 5'-UAAAUGUUGUACAGGAUAU-3' | (SEQ ID NO: 970) |
| LDHA-m1704 19 nt Target #2: | 5'-AUAAAUGUUGUACAGGAUA-3' | (SEQ ID NO: 1018) |
| LDHA-m1704 19 nt Target #3: | 5'-CAUAAAUGUUGUACAGGAU-3' | (SEQ ID NO: 1066) |
| LDHA-m1705 19 nt Target #1: | 5'-AAAUGUUGUACAGGAUAUU-3' | (SEQ ID NO: 971) |
| LDHA-m1705 19 nt Target #2: | 5'-UAAAUGUUGUACAGGAUAU-3' | (SEQ ID NO: 1019) |
| LDHA-m1705 19 nt Target #3: | 5'-AUAAAUGUUGUACAGGAUA-3' | (SEQ ID NO: 1067) |
| LDHA-m1706 19 nt Target #1: | 5'-AAUGUUGUACAGGAUAUUU-3' | (SEQ ID NO: 972) |
| LDHA-m1706 19 nt Target #2: | 5'-AAAUGUUGUACAGGAUAUU-3' | (SEQ ID NO: 1020) |
| LDHA-m1706 19 nt Target #3: | 5'-UAAAUGUUGUACAGGAUAU-3' | (SEQ ID NO: 1068) |

TABLE 11-continued

DsiRNA Component 19 Nucleotide Target Sequences in Mouse Lactate Dehydrogenase mRNA

```
LDHA-m1707 19 nt Target #1:  5'-AUGUUGUACAGGAUAUUUU-3'  (SEQ ID NO: 973)

LDHA-m1707 19 nt Target #2:  5'-AAUGUUGUACAGGAUAUUU-3'  (SEQ ID NO: 1021)

LDHA-m1707 19 nt Target #3:  5'-AAAUGUUGUACAGGAUAUU-3'  (SEQ ID NO: 1069)

LDHA-m1708 19 nt Target #1:  5'-UGUUGUACAGGAUAUUUUA-3'  (SEQ ID NO: 974)

LDHA-m1708 19 nt Target #2:  5'-AUGUUGUACAGGAUAUUUU-3'  (SEQ ID NO: 1022)

LDHA-m1708 19 nt Target #3:  5'-AAUGUUGUACAGGAUAUUU-3'  (SEQ ID NO: 1070)

LDHA-m1709 19 nt Target #1:  5'-GUUGUACAGGAUAUUUUAU-3'  (SEQ ID NO: 975)

LDHA-m1709 19 nt Target #2:  5'-UGUUGUACAGGAUAUUUUA-3'  (SEQ ID NO: 1023)

LDHA-m1709 19 nt Target #3:  5'-AUGUUGUACAGGAUAUUUU-3'  (SEQ ID NO: 1071)

LDHA-m1710 19 nt Target #1:  5'-UUGUACAGGAUAUUUUAUA-3'  (SEQ ID NO: 976)

LDHA-m1710 19 nt Target #2:  5'-GUUGUACAGGAUAUUUUAU-3'  (SEQ ID NO: 1024)

LDHA-m1710 19 nt Target #3:  5'-UGUUGUACAGGAUAUUUUA-3'  (SEQ ID NO: 1072)

LDHA-m1739 19 nt Target #1:  5'-GUCUGUAGUGUGCAUUGCA-3'  (SEQ ID NO: 977)

LDHA-m1739 19 nt Target #2:  5'-UGUCUGUAGUGUGCAUUGC-3'  (SEQ ID NO: 1025)

LDHA-m1739 19 nt Target #3:  5'-GUGUCUGUAGUGUGCAUUG-3'  (SEQ ID NO: 1073)

LDHA-m1743 19 nt Target #1:  5'-GUAGUGUGCAUUGCAAUAU-3'  (SEQ ID NO: 978)

LDHA-m1743 19 nt Target #2:  5'-UGUAGUGUGCAUUGCAAUA-3'  (SEQ ID NO: 1026)

LDHA-m1743 19 nt Target #3:  5'-CUGUAGUGUGCAUUGCAAU-3'  (SEQ ID NO: 1074)

LDHA-m1744 19 nt Target #1:  5'-UAGUGUGCAUUGCAAUAUU-3'  (SEQ ID NO: 979)

LDHA-m1744 19 nt Target #2:  5'-GUAGUGUGCAUUGCAAUAU-3'  (SEQ ID NO: 1027)

LDHA-m1744 19 nt Target #3:  5'-UGUAGUGUGCAUUGCAAUA-3'  (SEQ ID NO: 1075)

LDHA-m1746 19 nt Target #1:  5'-GUGUGCAUUGCAAUAUUAU-3'  (SEQ ID NO: 980)

LDHA-m1746 19 nt Target #2:  5'-AGUGUGCAUUGCAAUAUUA-3'  (SEQ ID NO: 1028)

LDHA-m1746 19 nt Target #3:  5'-UAGUGUGCAUUGCAAUAUU-3'  (SEQ ID NO: 1076)

LDHA-m1751 19 nt Target #1:  5'-CAUUGCAAUAUUAUGUGAG-3'  (SEQ ID NO: 981)

LDHA-m1751 19 nt Target #2:  5'-GCAUUGCAAUAUUAUGUGA-3'  (SEQ ID NO: 1029)

LDHA-m1751 19 nt Target #3:  5'-UGCAUUGCAAUAUUAUGUG-3'  (SEQ ID NO: 1077)

LDHA-m1752 19 nt Target #1:  5'-AUUGCAAUAUUAUGUGAGA-3'  (SEQ ID NO: 982)

LDHA-m1752 19 nt Target #2:  5'-CAUUGCAAUAUUAUGUGAG-3'  (SEQ ID NO: 1030)

LDHA-m1752 19 nt Target #3:  5'-GCAUUGCAAUAUUAUGUGA-3'  (SEQ ID NO: 1078)

LDHA-m1755 19 nt Target #1:  5'-GCAAUAUUAUGUGAGAUGU-3'  (SEQ ID NO: 983)

LDHA-m1755 19 nt Target #2:  5'-UGCAAUAUUAUGUGAGAUG-3'  (SEQ ID NO: 1031)

LDHA-m1755 19 nt Target #3:  5'-UUGCAAUAUUAUGUGAGAU-3'  (SEQ ID NO: 1079)

LDHA-m1756 19 nt Target #1:  5'-CAAUAUUAUGUGAGAUGUA-3'  (SEQ ID NO: 984)

LDHA-m1756 19 nt Target #2:  5'-GCAAUAUUAUGUGAGAUGU-3'  (SEQ ID NO: 1032)

LDHA-m1756 19 nt Target #3:  5'-UGCAAUAUUAUGUGAGAUG-3'  (SEQ ID NO: 1080)
```

TABLE 12

Additional Selected Human Anti-Lactate Dehydrogenase DsiRNA Agents (Asymmetrics)

| | | |
|---|---|---|
| LDHA-27 Target: | 5'-CUGCCGGUCGGUUGUCUGGCUGCgc-3'<br>3'-CAGACGGCCAGCCAACAGACCGACGCG-5'<br>5'-GTCTGCCGGTCGGTTGTCTGGCTGCGC-3' | (SEQ ID NO: 1081)<br>(SEQ ID NO: 3095)<br>(SEQ ID NO: 5109) |
| LDHA-28 Target: | 5'-UGCCGGUCGGUUGUCUGGCUGCcg-3'<br>3'-AGACGGCCAGCCAACAGACCGACGCGC-5'<br>5'-TCTGCCGGTCGGTTGTCTGGCTGCGCG-3' | (SEQ ID NO: 1082)<br>(SEQ ID NO: 3096)<br>(SEQ ID NO: 5110) |
| LDHA-29 Target: | 5'-GCCGGUCGGUUGUCUGGCUGCGCgc-3'<br>3'-GACGGCCAGCCAACAGACCGACGCGCG-5'<br>5'-CTGCCGGTCGGTTGTCTGGCTGCGCGC-3' | (SEQ ID NO: 1083)<br>(SEQ ID NO: 3097)<br>(SEQ ID NO: 5111) |
| LDHA-33 Target: | 5'-GUCGGUUGUCUGGCUGCGCGCGCca-3'<br>3'-GCCAGCCAACAGACCGACGCGCGCGGU-5'<br>5'-CGGTCGGTTGTCTGGCTGCGCGCGCCA-3' | (SEQ ID NO: 1084)<br>(SEQ ID NO: 3098)<br>(SEQ ID NO: 5112) |
| LDHA-72 Target: | 5'-GUGCCCCGCCUGGCUCGGCAUCCac-3'<br>3'-GUCACGGGGCGGACCGAGCCGUAGGUG-5'<br>5'-CAGTGCCCCGCCTGGCTCGGCATCCAC-3' | (SEQ ID NO: 1085)<br>(SEQ ID NO: 3099)<br>(SEQ ID NO: 5113) |
| LDHA-77 Target: | 5'-CCGCCUGGCUCGGCAUCCACCCCca-3'<br>3'-GGGGCGGACCGAGCCGUAGGUGGGGGU-5'<br>5'-CCCCGCCTGGCTCGGCATCCACCCCCA-3' | (SEQ ID NO: 1086)<br>(SEQ ID NO: 3100)<br>(SEQ ID NO: 5114) |
| LDHA-78 Target: | 5'-CGCCUGGCUCGGCAUCCACCCCCag-3'<br>3'-GGGCGGACCGAGCCGUAGGUGGGGGUC-5'<br>5'-CCCGCCTGGCTCGGCATCCACCCCCAG-3' | (SEQ ID NO: 1087)<br>(SEQ ID NO: 3101)<br>(SEQ ID NO: 5115) |
| LDHA-80 Target: | 5'-CCUGGCUCGGCAUCCACCCCCAGcc-3'<br>3'-GCGGACCGAGCCGUAGGUGGGGGUCGG-5'<br>5'-CGCCTGGCTCGGCATCCACCCCCAGCC-3' | (SEQ ID NO: 1088)<br>(SEQ ID NO: 3102)<br>(SEQ ID NO: 5116) |
| LDHA-82 Target: | 5'-UGGCUCGGCAUCCACCCCCAGCCcg-3'<br>3'-GGACCGAGCCGUAGGUGGGGGUCGGGC-5'<br>5'-CCTGGCTCGGCATCCACCCCCAGCCCG-3' | (SEQ ID NO: 1089)<br>(SEQ ID NO: 3103)<br>(SEQ ID NO: 5117) |
| LDHA-83 Target: | 5'-GGCUCGGCAUCCACCCCCAGCCCga-3'<br>3'-GACCGAGCCGUAGGUGGGGGUCGGGCU-5'<br>5'-CTGGCTCGGCATCCACCCCCAGCCCGA-3' | (SEQ ID NO: 1090)<br>(SEQ ID NO: 3104)<br>(SEQ ID NO: 5118) |
| LDHA-84 Target: | 5'-GCUCGGCAUCCACCCCCAGCCCGac-3'<br>3'-ACCGAGCCGUAGGUGGGGGUCGGGCUG-5'<br>5'-TGGCTCGGCATCCACCCCCAGCCCGAC-3' | (SEQ ID NO: 1091)<br>(SEQ ID NO: 3105)<br>(SEQ ID NO: 5119) |
| LDHA-85 Target: | 5'-CUCGGCAUCCACCCCCAGCCCGAct-3'<br>3'-CCGAGCCGUAGGUGGGGGUCGGGCUGA-5'<br>5'-GGCTCGGCATCCACCCCCAGCCCGACT-3' | (SEQ ID NO: 1092)<br>(SEQ ID NO: 3106)<br>(SEQ ID NO: 5120) |
| LDHA-86 Target: | 5'-UCGGCAUCCACCCCCAGCCCGACtc-3'<br>3'-CGAGCCGUAGGUGGGGGUCGGGCUGAG-5'<br>5'-GCTCGGCATCCACCCCCAGCCCGACTC-3' | (SEQ ID NO: 1093)<br>(SEQ ID NO: 3107)<br>(SEQ ID NO: 5121) |
| LDHA-87 Target: | 5'-CGGCAUCCACCCCCAGCCCGACUca-3'<br>3'-GAGCCGUAGGUGGGGGUCGGGCUGAGU-5'<br>5'-CTCGGCATCCACCCCCAGCCCGACTCA-3' | (SEQ ID NO: 1094)<br>(SEQ ID NO: 3108)<br>(SEQ ID NO: 5122) |
| LDHA-88 Target: | 5'-GGCAUCCACCCCCAGCCCGACUCac-3'<br>3'-AGCCGUAGGUGGGGGUCGGGCUGAGUG-5'<br>5'-TCGGCATCCACCCCCAGCCCGACTCAC-3' | (SEQ ID NO: 1095)<br>(SEQ ID NO: 3109)<br>(SEQ ID NO: 5123) |
| LDHA-89 Target: | 5'-GCAUCCACCCCCAGCCCGACUCAca-3'<br>3'-GCCGUAGGUGGGGGUCGGGCUGAGUGU-5'<br>5'-CGGCATCCACCCCCAGCCCGACTCACA-3' | (SEQ ID NO: 1096)<br>(SEQ ID NO: 3110)<br>(SEQ ID NO: 5124) |
| LDHA-90 Target: | 5'-CAUCCACCCCCAGCCCGACUCACac-3'<br>3'-CCGUAGGUGGGGGUCGGGCUGAGUGUG-5'<br>5'-GGCATCCACCCCCAGCCCGACTCACAC-3' | (SEQ ID NO: 1097)<br>(SEQ ID NO: 3111)<br>(SEQ ID NO: 5125) |
| LDHA-91 Target: | 5'-AUCCACCCCCAGCCCGACUCACAcg-3'<br>3'-CGUAGGUGGGGGUCGGGCUGAGUGUGC-5'<br>5'-GCATCCACCCCCAGCCCGACTCACACG-3' | (SEQ ID NO: 1098)<br>(SEQ ID NO: 3112)<br>(SEQ ID NO: 5126) |
| LDHA-92 Target: | 5'-UCCACCCCCAGCCCGACUCACACgt-3'<br>3'-GUAGGUGGGGGUCGGGCUGAGUGUGCA-5'<br>5'-CATCCACCCCCAGCCCGACTCACACGT-3' | (SEQ ID NO: 1099)<br>(SEQ ID NO: 3113)<br>(SEQ ID NO: 5127) |

TABLE 12-continued

Additional Selected Human Anti-Lactate Dehydrogenase DsiRNA Agents (Asymmetrics)

| | | |
|---|---|---|
| LDHA-93 Target: | 5'-CCACCCCCAGCCCGACUCACACGtg-3'<br>3'-UAGGUGGGGGUCGGGCUGAGUGUGCAC-5'<br>5'-ATCCACCCCAGCCCGACTCACACGTG-3' | (SEQ ID NO: 1100)<br>(SEQ ID NO: 3114)<br>(SEQ ID NO: 5128) |
| LDHA-94 Target: | 5'-CACCCCCAGCCCGACUCACACGUgg-3'<br>3'-AGGUGGGGGUCGGGCUGAGUGUGCACC-5'<br>5'-TCCACCCCCAGCCCGACTCACACGTGG-3' | (SEQ ID NO: 1101)<br>(SEQ ID NO: 3115)<br>(SEQ ID NO: 5129) |
| LDHA-95 Target: | 5'-ACCCCCAGCCCGACUCACACGUGgg-3'<br>3'-GGUGGGGGUCGGGCUGAGUGUGCACCC-5'<br>5'-CCACCCCCAGCCCGACTCACACGTGGG-3' | (SEQ ID NO: 1102)<br>(SEQ ID NO: 3116)<br>(SEQ ID NO: 5130) |
| LDHA-96 Target: | 5'-CCCCCAGCCCGACUCACACGUGGgt-3'<br>3'-GUGGGGGUCGGGCUGAGUGUGCACCCA-5'<br>5'-CACCCCCAGCCCGACTCACACGTGGGT-3' | (SEQ ID NO: 1103)<br>(SEQ ID NO: 3117)<br>(SEQ ID NO: 5131) |
| LDHA-97 Target: | 5'-CCCCAGCCCGACUCACACGUGGGtt-3'<br>3'-UGGGGGUCGGGCUGAGUGUGCACCCAA-5'<br>5'-ACCCCCAGCCCGACTCACACGTGGGTT-3' | (SEQ ID NO: 1104)<br>(SEQ ID NO: 3118)<br>(SEQ ID NO: 5132) |
| LDHA-98 Target: | 5'-CCCAGCCCGACUCACACGUGGGUtc-3'<br>3'-GGGGGUCGGGCUGAGUGUGCACCCAAG-5'<br>5'-CCCCCAGCCCGACTCACACGTGGGTTC-3' | (SEQ ID NO: 1105)<br>(SEQ ID NO: 3119)<br>(SEQ ID NO: 5133) |
| LDHA-99 Target: | 5'-CCAGCCCGACUCACACGUGGGUUcc-3'<br>3'-GGGGUCGGGCUGAGUGUGCACCCAAGG-5'<br>5'-CCCCAGCCCGACTCACACGTGGGTTCC-3' | (SEQ ID NO: 1106)<br>(SEQ ID NO: 3120)<br>(SEQ ID NO: 5134) |
| LDHA-100 Target: | 5'-CAGCCCGACUCACACGUGGGUUCcc-3'<br>3'-GGGUCGGGCUGAGUGUGCACCCAAGGG-5'<br>5'-CCCAGCCCGACTCACACGTGGGTTCCC-3' | (SEQ ID NO: 1107)<br>(SEQ ID NO: 3121)<br>(SEQ ID NO: 5135) |
| LDHA-101 Target: | 5'-AGCCCGACUCACACGUGGGUUCCcg-3'<br>3'-GGUCGGGCUGAGUGUGCACCCAAGGGC-5'<br>5'-CCAGCCCGACTCACACGTGGGTTCCCG-3' | (SEQ ID NO: 1108)<br>(SEQ ID NO: 3122)<br>(SEQ ID NO: 5136) |
| LDHA-102 Target: | 5'-GCCCGACUCACACGUGGGUUCCCgc-3'<br>3'-GUCGGGCUGAGUGUGCACCCAAGGGCG-5'<br>5'-CAGCCCGACTCACACGTGGGTTCCCGC-3' | (SEQ ID NO: 1109)<br>(SEQ ID NO: 3123)<br>(SEQ ID NO: 5137) |
| LDHA-103 Target: | 5'-CCCGACUCACACGUGGGUUCCCGca-3'<br>3'-UCGGGCUGAGUGUGCACCCAAGGGCGU-5'<br>5'-AGCCCGACTCACACGTGGGTTCCCGCA-3' | (SEQ ID NO: 1110)<br>(SEQ ID NO: 3124)<br>(SEQ ID NO: 5138) |
| LDHA-104 Target: | 5'-CCGACUCACACGUGGGUUCCCGCac-3'<br>3'-CGGGCUGAGUGUGCACCCAAGGGCGUG-5'<br>5'-GCCCGACTCACACGTGGGTTCCCGCAC-3' | (SEQ ID NO: 1111)<br>(SEQ ID NO: 3125)<br>(SEQ ID NO: 5139) |
| LDHA-105 Target: | 5'-CGACUCACACGUGGGUUCCCGCAcg-3'<br>3'-GGGCUGAGUGUGCACCCAAGGGCGUGC-5'<br>5'-CCCGACTCACACGTGGGTTCCCGCACG-3' | (SEQ ID NO: 1112)<br>(SEQ ID NO: 3126)<br>(SEQ ID NO: 5140) |
| LDHA-106 Target: | 5'-GACUCACACGUGGGUUCCCGCACgt-3'<br>3'-GGCUGAGUGUGCACCCAAGGGCGUGCA-5'<br>5'-CCGACTCACACGTGGGTTCCCGCACGT-3' | (SEQ ID NO: 1113)<br>(SEQ ID NO: 3127)<br>(SEQ ID NO: 5141) |
| LDHA-107 Target: | 5'-ACUCACACGUGGGUUCCCGCACGtc-3'<br>3'-GCUGAGUGUGCACCCAAGGGCGUGCAG-5'<br>5'-CGACTCACACGTGGGTTCCCGCACGTC-3' | (SEQ ID NO: 1114)<br>(SEQ ID NO: 3128)<br>(SEQ ID NO: 5142) |
| LDHA-108 Target: | 5'-CUCACACGUGGGUUCCCGCACGUcc-3'<br>3'-CUGAGUGUGCACCCAAGGGCGUGCAGG-5'<br>5'-GACTCACACGTGGGTTCCCGCACGTCC-3' | (SEQ ID NO: 1115)<br>(SEQ ID NO: 3129)<br>(SEQ ID NO: 5143) |
| LDHA-109 Target: | 5'-UCACACGUGGGUUCCCGCACGUCcg-3'<br>3'-UGAGUGUGCACCCAAGGGCGUGCAGGC-5'<br>5'-ACTCACACGTGGGTTCCCGCACGTCCG-3' | (SEQ ID NO: 1116)<br>(SEQ ID NO: 3130)<br>(SEQ ID NO: 5144) |
| LDHA-110 Target: | 5'-CACACGUGGGUUCCCGCACGUCCgc-3'<br>3'-GAGUGUGCACCCAAGGGCGUGCAGGCG-5'<br>5'-CTCACACGTGGGTTCCCGCACGTCCGC-3' | (SEQ ID NO: 1117)<br>(SEQ ID NO: 3131)<br>(SEQ ID NO: 5145) |
| LDHA-111 Target: | 5'-ACACGUGGGUUCCCGCACGUCCgcc-3'<br>3'-AGUGUGCACCCAAGGGCGUGCAGGCGG-5'<br>5'-TCACACGTGGGTTCCCGCACGTCCGCC-3' | (SEQ ID NO: 1118)<br>(SEQ ID NO: 3132)<br>(SEQ ID NO: 5146) |

TABLE 12-continued

Additional Selected Human Anti-Lactate Dehydrogenase DsiRNA Agents (Asymmetrics)

| | | |
|---|---|---|
| LDHA-112 Target: | 5'-CACGUGGGUUCCCGCACGUCCGCcg-3'<br>3'-GUGUGCACCCAAGGGCGUGCAGGCGGC-5'<br>5'-CACACGTGGGTTCCCGCACGTCCGCCG-3' | (SEQ ID NO: 1119)<br>(SEQ ID NO: 3133)<br>(SEQ ID NO: 5147) |
| LDHA-135 Target: | 5'-CGGCCCCCCCCGCUGACGUCAGCat-3'<br>3'-CGGCCGGGGGGGGCGACUGCAGUCGUA-5'<br>5'-GCCGGCCCCCCCCGCTGACGTCAGCAT-3' | (SEQ ID NO: 1120)<br>(SEQ ID NO: 3134)<br>(SEQ ID NO: 5148) |
| LDHA-136 Target: | 5'-GGCCCCCCCCGCUGACGUCAGCAta-3'<br>3'-GGCCGGGGGGGGCGACUGCAGUCGUAU-5'<br>5'-CCGGCCCCCCCCGCTGACGTCAGCATA-3' | (SEQ ID NO: 1121)<br>(SEQ ID NO: 3135)<br>(SEQ ID NO: 5149) |
| LDHA-137 Target: | 5'-GCCCCCCCCGCUGACGUCAGCAUag-3'<br>3'-GCCGGGGGGGGCGACUGCAGUCGUAUC-5'<br>5'-CGGCCCCCCCCGCTGACGTCAGCATAG-3' | (SEQ ID NO: 1122)<br>(SEQ ID NO: 3136)<br>(SEQ ID NO: 5150) |
| LDHA-138 Target: | 5'-CCCCCCCCGCUGACGUCAGCAUAgc-3'<br>3'-CCGGGGGGGGCGACUGCAGUCGUAUCG-5'<br>5'-GGCCCCCCCCGCTGACGTCAGCATAGC-3' | (SEQ ID NO: 1123)<br>(SEQ ID NO: 3137)<br>(SEQ ID NO: 5151) |
| LDHA-139 Target: | 5'-CCCCCCCGCUGACGUCAGCAUAGct-3'<br>3'-CGGGGGGGGCGACUGCAGUCGUAUCGA-5'<br>5'-GCCCCCCCCGCTGACGTCAGCATAGCT-3' | (SEQ ID NO: 1124)<br>(SEQ ID NO: 3138)<br>(SEQ ID NO: 5152) |
| LDHA-140 Target: | 5'-CCCCCCGCUGACGUCAGCAUAGCtg-3'<br>3'-GGGGGGGGCGACUGCAGUCGUAUCGAC-5'<br>5'-CCCCCCCCGCTGACGTCAGCATAGCTG-3' | (SEQ ID NO: 1125)<br>(SEQ ID NO: 3139)<br>(SEQ ID NO: 5153) |
| LDHA-141 Target: | 5'-CCCCCGCUGACGUCAGCAUAGCUgt-3'<br>3'-GGGGGGGCGACUGCAGUCGUAUCGACA-5'<br>5'-CCCCCCCGCTGACGTCAGCATAGCTGT-3' | (SEQ ID NO: 1126)<br>(SEQ ID NO: 3140)<br>(SEQ ID NO: 5154) |
| LDHA-142 Target: | 5'-CCCCGCUGACGUCAGCAUAGCUGtt-3'<br>3'-GGGGGGCGACUGCAGUCGUAUCGACAA-5'<br>5'-CCCCCCGCTGACGTCAGCATAGCTGTT-3' | (SEQ ID NO: 1127)<br>(SEQ ID NO: 3141)<br>(SEQ ID NO: 5155) |
| LDHA-143 Target: | 5'-CCCGCUGACGUCAGCAUAGCUGUtc-3'<br>3'-GGGGGCGACUGCAGUCGUAUCGACAAG-5'<br>5'-CCCCCGCTGACGTCAGCATAGCTGTTC-3' | (SEQ ID NO: 1128)<br>(SEQ ID NO: 3142)<br>(SEQ ID NO: 5156) |
| LDHA-144 Target: | 5'-CCGCUGACGUCAGCAUAGCUGUUcc-3'<br>3'-GGGGCGACUGCAGUCGUAUCGACAAGG-5'<br>5'-CCCCGCTGACGTCAGCATAGCTGTTCC-3' | (SEQ ID NO: 1129)<br>(SEQ ID NO: 3143)<br>(SEQ ID NO: 5157) |
| LDHA-145 Target: | 5'-CGCUGACGUCAGCAUAGCUGUUCca-3'<br>3'-GGGCGACUGCAGUCGUAUCGACAAGGU-5'<br>5'-CCCGCTGACGTCAGCATAGCTGTTCCA-3' | (SEQ ID NO: 1130)<br>(SEQ ID NO: 3144)<br>(SEQ ID NO: 5158) |
| LDHA-146 Target: | 5'-GCUGACGUCAGCAUAGCUGUUCCac-3'<br>3'-GGCGACUGCAGUCGUAUCGACAAGGUG-5'<br>5'-CCGCTGACGTCAGCATAGCTGTTCCAC-3' | (SEQ ID NO: 1131)<br>(SEQ ID NO: 3145)<br>(SEQ ID NO: 5159) |
| LDHA-147 Target: | 5'-CUGACGUCAGCAUAGCUGUUCCAct-3'<br>3'-GCGACUGCAGUCGUAUCGACAAGGUGA-5'<br>5'-CGCTGACGTCAGCATAGCTGTTCCACT-3' | (SEQ ID NO: 1132)<br>(SEQ ID NO: 3146)<br>(SEQ ID NO: 5160) |
| LDHA-148 Target: | 5'-UGACGUCAGCAUAGCUGUUCCACtt-3'<br>3'-CGACUGCAGUCGUAUCGACAAGGUGAA-5'<br>5'-GCTGACGTCAGCATAGCTGTTCCACTT-3' | (SEQ ID NO: 1133)<br>(SEQ ID NO: 3147)<br>(SEQ ID NO: 5161) |
| LDHA-149 Target: | 5'-GACGUCAGCAUAGCUGUUCCACUta-3'<br>3'-GACUGCAGUCGUAUCGACAAGGUGAAU-5'<br>5'-CTGACGTCAGCATAGCTGTTCCACTTA-3' | (SEQ ID NO: 1134)<br>(SEQ ID NO: 3148)<br>(SEQ ID NO: 5162) |
| LDHA-150 Target: | 5'-ACGUCAGCAUAGCUGUUCCACUUaa-3'<br>3'-ACUGCAGUCGUAUCGACAAGGUGAAUU-5'<br>5'-TGACGTCAGCATAGCTGTTCCACTTAA-3' | (SEQ ID NO: 1135)<br>(SEQ ID NO: 3149)<br>(SEQ ID NO: 5163) |
| LDHA-151 Target: | 5'-CGUCAGCAUAGCUGUUCCACUUAag-3'<br>3'-CUGCAGUCGUAUCGACAAGGUGAAUUC-5'<br>5'-GACGTCAGCATAGCTGTTCCACTTAAG-3' | (SEQ ID NO: 1136)<br>(SEQ ID NO: 3150)<br>(SEQ ID NO: 5164) |
| LDHA-152 Target: | 5'-GUCAGCAUAGCUGUUCCACUUAAgg-3'<br>3'-UGCAGUCGUAUCGACAAGGUGAAUUCC-5'<br>5'-ACGTCAGCATAGCTGTTCCACTTAAGG-3' | (SEQ ID NO: 1137)<br>(SEQ ID NO: 3151)<br>(SEQ ID NO: 5165) |

TABLE 12-continued

Additional Selected Human Anti-Lactate Dehydrogenase DsiRNA Agents (Asymmetrics)

| | | |
|---|---|---|
| LDHA-153 Target: | 5'-UCAGCAUAGCUGUUCCACUUAAGgc-3'<br>3'-GCAGUCGUAUCGACAAGGUGAAUUCCG-5'<br>5'-CGTCAGCATAGCTGTTCCACTTAAGGC-3' | (SEQ ID NO: 1138)<br>(SEQ ID NO: 3152)<br>(SEQ ID NO: 5166) |
| LDHA-154 Target: | 5'-CAGCAUAGCUGUUCCACUUAAGGcc-3'<br>3'-CAGUCGUAUCGACAAGGUGAAUUCCGG-5'<br>5'-GTCAGCATAGCTGTTCCACTTAAGGCC-3' | (SEQ ID NO: 1139)<br>(SEQ ID NO: 3153)<br>(SEQ ID NO: 5167) |
| LDHA-155 Target: | 5'-AGCAUAGCUGUUCCACUUAAGGCcc-3'<br>3'-AGUCGUAUCGACAAGGUGAAUUCCGGG-5'<br>5'-TCAGCATAGCTGTTCCACTTAAGGCCC-3' | (SEQ ID NO: 1140)<br>(SEQ ID NO: 3154)<br>(SEQ ID NO: 5168) |
| LDHA-156 Target: | 5'-GCAUAGCUGUUCCACUUAAGGCCcc-3'<br>3'-GUCGUAUCGACAAGGUGAAUUCCGGGG-5'<br>5'-CAGCATAGCTGTTCCACTTAAGGCCCC-3' | (SEQ ID NO: 1141)<br>(SEQ ID NO: 3155)<br>(SEQ ID NO: 5169) |
| LDHA-157 Target: | 5'-CAUAGCUGUUCCACUUAAGGCCCct-3'<br>3'-UCGUAUCGACAAGGUGAAUUCCGGGGA-5'<br>5'-AGCATAGCTGTTCCACTTAAGGCCCCT-3' | (SEQ ID NO: 1142)<br>(SEQ ID NO: 3156)<br>(SEQ ID NO: 5170) |
| LDHA-158 Target: | 5'-AUAGCUGUUCCACUUAAGGCCCCtc-3'<br>3'-CGUAUCGACAAGGUGAAUUCCGGGGAG-5'<br>5'-GCATAGCTGTTCCACTTAAGGCCCCTC-3' | (SEQ ID NO: 1143)<br>(SEQ ID NO: 3157)<br>(SEQ ID NO: 5171) |
| LDHA-159 Target: | 5'-UAGCUGUUCCACUUAAGGCCCCUcc-3'<br>3'-GUAUCGACAAGGUGAAUUCCGGGGAGG-5'<br>5'-CATAGCTGTTCCACTTAAGGCCCCTCC-3' | (SEQ ID NO: 1144)<br>(SEQ ID NO: 3158)<br>(SEQ ID NO: 5172) |
| LDHA-160 Target: | 5'-AGCUGUUCCACUUAAGGCCCCUCcc-3'<br>3'-UAUCGACAAGGUGAAUUCCGGGGAGGG-5'<br>5'-ATAGCTGTTCCACTTAAGGCCCCTCCC-3' | (SEQ ID NO: 1145)<br>(SEQ ID NO: 3159)<br>(SEQ ID NO: 5173) |
| LDHA-161 Target: | 5'-GCUGUUCCACUUAAGGCCCCUCCcg-3'<br>3'-AUCGACAAGGUGAAUUCCGGGGAGGGC-5'<br>5'-TAGCTGTTCCACTTAAGGCCCCTCCCG-3' | (SEQ ID NO: 1146)<br>(SEQ ID NO: 3160)<br>(SEQ ID NO: 5174) |
| LDHA-162 Target: | 5'-CUGUUCCACUUAAGGCCCCUCCCgc-3'<br>3'-UCGACAAGGUGAAUUCCGGGGAGGGCG-5'<br>5'-AGCTGTTCCACTTAAGGCCCCTCCCGC-3' | (SEQ ID NO: 1147)<br>(SEQ ID NO: 3161)<br>(SEQ ID NO: 5175) |
| LDHA-179 Target: | 5'-CCUCCCGCGCCCAGCUCAGAGUGct-3'<br>3'-GGGGAGGGCGCGGGUCGAGUCUCACGA-5'<br>5'-CCCCTCCCGCGCCCAGCTCAGAGTGCT-3' | (SEQ ID NO: 1148)<br>(SEQ ID NO: 3162)<br>(SEQ ID NO: 5176) |
| LDHA-182 Target: | 5'-CCCGCGCCCAGCUCAGAGUGCUGca-3'<br>3'-GAGGGCGCGGGUCGAGUCUCACGACGU-5'<br>5'-CTCCCGCGCCCAGCTCAGAGTGCTGCA-3' | (SEQ ID NO: 1149)<br>(SEQ ID NO: 3163)<br>(SEQ ID NO: 5177) |
| LDHA-183 Target: | 5'-CCGCGCCCAGCUCAGAGUGCUGCag-3'<br>3'-AGGGCGCGGGUCGAGUCUCACGACGUC-5'<br>5'-TCCCGCGCCCAGCTCAGAGTGCTGCAG-3' | (SEQ ID NO: 1150)<br>(SEQ ID NO: 3164)<br>(SEQ ID NO: 5178) |
| LDHA-184 Target: | 5'-CGCGCCCAGCUCAGAGUGCUGCAgc-3'<br>3'-GGGCGCGGGUCGAGUCUCACGACGUCG-5'<br>5'-CCCGCGCCCAGCTCAGAGTGCTGCAGC-3' | (SEQ ID NO: 1151)<br>(SEQ ID NO: 3165)<br>(SEQ ID NO: 5179) |
| LDHA-185 Target: | 5'-GCGCCCAGCUCAGAGUGCUGCAGcc-3'<br>3'-GGCGCGGGUCGAGUCUCACGACGUCGG-5'<br>5'-CCGCGCCCAGCTCAGAGTGCTGCAGCC-3' | (SEQ ID NO: 1152)<br>(SEQ ID NO: 3166)<br>(SEQ ID NO: 5180) |
| LDHA-187 Target: | 5'-GCCCAGCUCAGAGUGCUGCAGCCgc-3'<br>3'-CGCGGGUCGAGUCUCACGACGUCGGCG-5'<br>5'-GCGCCCAGCTCAGAGTGCTGCAGCCGC-3' | (SEQ ID NO: 1153)<br>(SEQ ID NO: 3167)<br>(SEQ ID NO: 5181) |
| LDHA-188 Target: | 5'-CCCAGCUCAGAGUGCUGCAGCCGct-3'<br>3'-GCGGGUCGAGUCUCACGACGUCGGCGA-5'<br>5'-CGCCCAGCTCAGAGTGCTGCAGCCGCT-3' | (SEQ ID NO: 1154)<br>(SEQ ID NO: 3168)<br>(SEQ ID NO: 5182) |
| LDHA-190 Target: | 5'-CAGCUCAGAGUGCUGCAGCCGCUgc-3'<br>3'-GGGUCGAGUCUCACGACGUCGGCGACG-5'<br>5'-CCCAGCTCAGAGTGCTGCAGCCGCTGC-3' | (SEQ ID NO: 1155)<br>(SEQ ID NO: 3169)<br>(SEQ ID NO: 5183) |
| LDHA-191 Target: | 5'-AGCUCAGAGUGCUGCAGCCGCUGcc-3'<br>3'-GGUCGAGUCUCACGACGUCGGCGACGG-5'<br>5'-CCAGCTCAGAGTGCTGCAGCCGCTGCC-3' | (SEQ ID NO: 1156)<br>(SEQ ID NO: 3170)<br>(SEQ ID NO: 5184) |

TABLE 12-continued

Additional Selected Human Anti-Lactate Dehydrogenase DsiRNA Agents (Asymmetrics)

| | | |
|---|---|---|
| LDHA-192 Target: | 5'-GCUCAGAGUGCUGCAGCCGCUGCcg-3'<br>3'-GUCGAGUCUCACGACGUCGGCGACGGC-5'<br>5'-CAGCTCAGAGTGCTGCAGCCGCTGCCG-3' | (SEQ ID NO: 1157)<br>(SEQ ID NO: 3171)<br>(SEQ ID NO: 5185) |
| LDHA-193 Target: | 5'-CUCAGAGUGCUGCAGCCGCUGCCgc-3'<br>3'-UCGAGUCUCACGACGUCGGCGACGGCG-5'<br>5'-AGCTCAGAGTGCTGCAGCCGCTGCCGC-3' | (SEQ ID NO: 1158)<br>(SEQ ID NO: 3172)<br>(SEQ ID NO: 5186) |
| LDHA-208 Target: | 5'-CCGCUGCCGCCGAUUCCGGAUCUca-3'<br>3'-UCGGCGACGGCGGCUAAGGCCUAGAGU-5'<br>5'-AGCCGCTGCCGCCGATTCCGGATCTCA-3' | (SEQ ID NO: 1159)<br>(SEQ ID NO: 3173)<br>(SEQ ID NO: 5187) |
| LDHA-209 Target: | 5'-CGCUGCCGCCGAUUCCGGAUCUCat-3'<br>3'-CGGCGACGGCGGCUAAGGCCUAGAGUA-5'<br>5'-GCCGCTGCCGCCGATTCCGGATCTCAT-3' | (SEQ ID NO: 1160)<br>(SEQ ID NO: 3174)<br>(SEQ ID NO: 5188) |
| LDHA-210 Target: | 5'-GCUGCCGCCGAUUCCGGAUCUCAtt-3'<br>3'-GGCGACGGCGGCUAAGGCCUAGAGUAA-5'<br>5'-CCGCTGCCGCCGATTCCGGATCTCATT-3' | (SEQ ID NO: 1161)<br>(SEQ ID NO: 3175)<br>(SEQ ID NO: 5189) |
| LDHA-211 Target: | 5'-CUGCCGCCGAUUCCGGAUCUCAUtg-3'<br>3'-GCGACGGCGGCUAAGGCCUAGAGUAAC-5'<br>5'-CGCTGCCGCCGATTCCGGATCTCATTG-3' | (SEQ ID NO: 1162)<br>(SEQ ID NO: 3176)<br>(SEQ ID NO: 5190) |
| LDHA-212 Target: | 5'-UGCCGCCGAUUCCGGAUCUCAUUgc-3'<br>3'-CGACGGCGGCUAAGGCCUAGAGUAACG-5'<br>5'-GCTGCCGCCGATTCCGGATCTCATTGC-3' | (SEQ ID NO: 1163)<br>(SEQ ID NO: 3177)<br>(SEQ ID NO: 5191) |
| LDHA-213 Target: | 5'-GCCGCCGAUUCCGGAUCUCAUUGcc-3'<br>3'-GACGGCGGCUAAGGCCUAGAGUAACGG-5'<br>5'-CTGCCGCCGATTCCGGATCTCATTGCC-3' | (SEQ ID NO: 1164)<br>(SEQ ID NO: 3178)<br>(SEQ ID NO: 5192) |
| LDHA-214 Target: | 5'-CCGCCGAUUCCGGAUCUCAUUGCca-3'<br>3'-ACGGCGGCUAAGGCCUAGAGUAACGGU-5'<br>5'-TGCCGCCGATTCCGGATCTCATTGCCA-3' | (SEQ ID NO: 1165)<br>(SEQ ID NO: 3179)<br>(SEQ ID NO: 5193) |
| LDHA-215 Target: | 5'-CGCCGAUUCCGGAUCUCAUUGCCac-3'<br>3'-CGGCGGCUAAGGCCUAGAGUAACGGUG-5'<br>5'-GCCGCCGATTCCGGATCTCATTGCCAC-3' | (SEQ ID NO: 1166)<br>(SEQ ID NO: 3180)<br>(SEQ ID NO: 5194) |
| LDHA-216 Target: | 5'-GCCGAUUCCGGAUCUCAUUGCCAcg-3'<br>3'-GGCGGCUAAGGCCUAGAGUAACGGUGC-5'<br>5'-CCGCCGATTCCGGATCTCATTGCCACG-3' | (SEQ ID NO: 1167)<br>(SEQ ID NO: 3181)<br>(SEQ ID NO: 5195) |
| LDHA-217 Target: | 5'-CCGAUUCCGGAUCUCAUUGCCACgc-3'<br>3'-GCGGCUAAGGCCUAGAGUAACGGUGCG-5'<br>5'-CGCCGATTCCGGATCTCATTGCCACGC-3' | (SEQ ID NO: 1168)<br>(SEQ ID NO: 3182)<br>(SEQ ID NO: 5196) |
| LDHA-218 Target: | 5'-CGAUUCCGGAUCUCAUUGCCACGcg-3'<br>3'-CGGCUAAGGCCUAGAGUAACGGUGCGC-5'<br>5'-GCCGATTCCGGATCTCATTGCCACGCG-3' | (SEQ ID NO: 1169)<br>(SEQ ID NO: 3183)<br>(SEQ ID NO: 5197) |
| LDHA-219 Target: | 5'-GAUUCCGGAUCUCAUUGCCACGCgc-3'<br>3'-GGCUAAGGCCUAGAGUAACGGUGCGCG-5'<br>5'-CCGATTCCGGATCTCATTGCCACGCGC-3' | (SEQ ID NO: 1170)<br>(SEQ ID NO: 3184)<br>(SEQ ID NO: 5198) |
| LDHA-220 Target: | 5'-AUUCCGGAUCUCAUUGCCACGCGcc-3'<br>3'-GCUAAGGCCUAGAGUAACGGUGCGCGG-5'<br>5'-CGATTCCGGATCTCATTGCCACGCGCC-3' | (SEQ ID NO: 1171)<br>(SEQ ID NO: 3185)<br>(SEQ ID NO: 5199) |
| LDHA-221 Target: | 5'-UUCCGGAUCUCAUUGCCACGCGCcc-3'<br>3'-CUAAGGCCUAGAGUAACGGUGCGCGGG-5'<br>5'-GATTCCGGATCTCATTGCCACGCGCCC-3' | (SEQ ID NO: 1172)<br>(SEQ ID NO: 3186)<br>(SEQ ID NO: 5200) |
| LDHA-222 Target: | 5'-UCCGGAUCUCAUUGCCACGCGCCcc-3'<br>3'-UAAGGCCUAGAGUAACGGUGCGCGGGG-5'<br>5'-ATTCCGGATCTCATTGCCACGCGCCCC-3' | (SEQ ID NO: 1173)<br>(SEQ ID NO: 3187)<br>(SEQ ID NO: 5201) |
| LDHA-223 Target: | 5'-CCGGAUCUCAUUGCCACGCGCCCcc-3'<br>3'-AAGGCCUAGAGUAACGGUGCGCGGGGG-5'<br>5'-TTCCGGATCTCATTGCCACGCGCCCCC-3' | (SEQ ID NO: 1174)<br>(SEQ ID NO: 3188)<br>(SEQ ID NO: 5202) |
| LDHA-224 Target: | 5'-CGGAUCUCAUUGCCACGCGCCCCcg-3'<br>3'-AGGCCUAGAGUAACGGUGCGCGGGGGC-5'<br>5'-TCCGGATCTCATTGCCACGCGCCCCCG-3' | (SEQ ID NO: 1175)<br>(SEQ ID NO: 3189)<br>(SEQ ID NO: 5203) |

TABLE 12-continued

Additional Selected Human Anti-Lactate Dehydrogenase DsiRNA Agents (Asymmetrics)

| | | |
|---|---|---|
| LDHA-225 | 5'-GGAUCUCAUUGCCACGCGCCCCCga-3'<br>3'-GGCCUAGAGUAACGGUGCGCGGGGGCU-5'<br>Target: 5'-CCGGATCTCATTGCCACGCGCCCCCGA-3' | (SEQ ID NO: 1176)<br>(SEQ ID NO: 3190)<br>(SEQ ID NO: 5204) |
| LDHA-226 | 5'-GAUCUCAUUGCCACGCGCCCCCGac-3'<br>3'-GCCUAGAGUAACGGUGCGCGGGGGCUG-5'<br>Target: 5'-CGGATCTCATTGCCACGCGCCCCCGAC-3' | (SEQ ID NO: 1177)<br>(SEQ ID NO: 3191)<br>(SEQ ID NO: 5205) |
| LDHA-227 | 5'-AUCUCAUUGCCACGCGCCCCCGAcg-3'<br>3'-CCUAGAGUAACGGUGCGCGGGGGCUGC-5'<br>Target: 5'-GGATCTCATTGCCACGCGCCCCCGACG-3' | (SEQ ID NO: 1178)<br>(SEQ ID NO: 3192)<br>(SEQ ID NO: 5206) |
| LDHA-228 | 5'-UCUCAUUGCCACGCGCCCCCGACga-3'<br>3'-CUAGAGUAACGGUGCGCGGGGGCUGCU-5'<br>Target: 5'-GATCTCATTGCCACGCGCCCCCGACGA-3' | (SEQ ID NO: 1179)<br>(SEQ ID NO: 3193)<br>(SEQ ID NO: 5207) |
| LDHA-229 | 5'-CUCAUUGCCACGCGCCCCCGACGac-3'<br>3'-UAGAGUAACGGUGCGCGGGGGCUGCUG-5'<br>Target: 5'-ATCTCATTGCCACGCGCCCCCGACGAC-3' | (SEQ ID NO: 1180)<br>(SEQ ID NO: 3194)<br>(SEQ ID NO: 5208) |
| LDHA-230 | 5'-UCAUUGCCACGCGCCCCCGACGAcc-3'<br>3'-AGAGUAACGGUGCGCGGGGGCUGCUGG-5'<br>Target: 5'-TCTCATTGCCACGCGCCCCCGACGACC-3' | (SEQ ID NO: 1181)<br>(SEQ ID NO: 3195)<br>(SEQ ID NO: 5209) |
| LDHA-231 | 5'-CAUUGCCACGCGCCCCCGACGACcg-3'<br>3'-GAGUAACGGUGCGCGGGGGCUGCUGGC-5'<br>Target: 5'-CTCATTGCCACGCGCCCCCGACGACCG-3' | (SEQ ID NO: 1182)<br>(SEQ ID NO: 3196)<br>(SEQ ID NO: 5210) |
| LDHA-232 | 5'-AUUGCCACGCGCCCCCGACGACCgc-3'<br>3'-AGUAACGGUGCGCGGGGGCUGCUGGCG-5'<br>Target: 5'-TCATTGCCACGCGCCCCCGACGACCGC-3' | (SEQ ID NO: 1183)<br>(SEQ ID NO: 3197)<br>(SEQ ID NO: 5211) |
| LDHA-244 | 5'-CCCCGACGACCGCCCGACGUGCAtt-3'<br>3'-CGGGGCUGCUGGCGGGCUGCACGUAA-5'<br>Target: 5'-GCCCCGACGACCGCCCGACGTGCATT-3' | (SEQ ID NO: 1184)<br>(SEQ ID NO: 3198)<br>(SEQ ID NO: 5212) |
| LDHA-245 | 5'-CCCGACGACCGCCCGACGUGCAUtc-3'<br>3'-GGGGGCUGCUGGCGGGCUGCACGUAAG-5'<br>Target: 5'-CCCCCGACGACCGCCCGACGTGCATTC-3' | (SEQ ID NO: 1185)<br>(SEQ ID NO: 3199)<br>(SEQ ID NO: 5213) |
| LDHA-246 | 5'-CCGACGACCGCCCGACGUGCAUUcc-3'<br>3'-GGGGCUGCUGGCGGGCUGCACGUAAGG-5'<br>Target: 5'-CCCCGACGACCGCCCGACGTGCATTCC-3' | (SEQ ID NO: 1186)<br>(SEQ ID NO: 3200)<br>(SEQ ID NO: 5214) |
| LDHA-247 | 5'-CGACGACCGCCCGACGUGCAUUCcc-3'<br>3'-GGGCUGCUGGCGGGCUGCACGUAAGGG-5'<br>Target: 5'-CCCGACGACCGCCCGACGTGCATTCCC-3' | (SEQ ID NO: 1187)<br>(SEQ ID NO: 3201)<br>(SEQ ID NO: 5215) |
| LDHA-248 | 5'-GACGACCGCCCGACGUGCAUUCCcg-3'<br>3'-GGCUGCUGGCGGGCUGCACGUAAGGGC-5'<br>Target: 5'-CCGACGACCGCCCGACGTGCATTCCCG-3' | (SEQ ID NO: 1188)<br>(SEQ ID NO: 3202)<br>(SEQ ID NO: 5216) |
| LDHA-249 | 5'-ACGACCGCCCGACGUGCAUUCCCga-3'<br>3'-GCUGCUGGCGGGCUGCACGUAAGGGCU-5'<br>Target: 5'-CGACGACCGCCCGACGTGCATTCCCGA-3' | (SEQ ID NO: 1189)<br>(SEQ ID NO: 3203)<br>(SEQ ID NO: 5217) |
| LDHA-250 | 5'-CGACCGCCCGACGUGCAUUCCCGat-3'<br>3'-CUGCUGGCGGGCUGCACGUAAGGGCUA-5'<br>Target: 5'-GACGACCGCCCGACGTGCATTCCCGAT-3' | (SEQ ID NO: 1190)<br>(SEQ ID NO: 3204)<br>(SEQ ID NO: 5218) |
| LDHA-251 | 5'-GACCGCCCGACGUGCAUUCCCGAtt-3'<br>3'-UGCUGGCGGGCUGCACGUAAGGGCUAA-5'<br>Target: 5'-ACGACCGCCCGACGTGCATTCCCGATT-3' | (SEQ ID NO: 1191)<br>(SEQ ID NO: 3205)<br>(SEQ ID NO: 5219) |
| LDHA-252 | 5'-ACCGCCCGACGUGCAUUCCCGAUtc-3'<br>3'-GCUGGCGGGCUGCACGUAAGGGCUAAG-5'<br>Target: 5'-CGACCGCCCGACGTGCATTCCCGATTC-3' | (SEQ ID NO: 1192)<br>(SEQ ID NO: 3206)<br>(SEQ ID NO: 5220) |
| LDHA-253 | 5'-CCGCCCGACGUGCAUUCCCGAUUcc-3'<br>3'-CUGGCGGGCUGCACGUAAGGGCUAAGG-5'<br>Target: 5'-GACCGCCCGACGTGCATTCCCGATTCC-3' | (SEQ ID NO: 1193)<br>(SEQ ID NO: 3207)<br>(SEQ ID NO: 5221) |
| LDHA-254 | 5'-CGCCCGACGUGCAUUCCCGAUUCct-3'<br>3'-UGGCGGGCUGCACGUAAGGGCUAAGGA-5'<br>Target: 5'-ACCGCCCGACGTGCATTCCCGATTCCT-3' | (SEQ ID NO: 1194)<br>(SEQ ID NO: 3208)<br>(SEQ ID NO: 5222) |

TABLE 12-continued

Additional Selected Human Anti-Lactate Dehydrogenase DsiRNA Agents (Asymmetrics)

| | | |
|---|---|---|
| LDHA-255 Target: | 5'-GCCCGACGUGCAUUCCCGAUUCCtt-3'<br>3'-GGCGGGCUGCACGUAAGGGCUAAGGAA-5'<br>5'-CCGCCCGACGTGCATTCCCGATTCCTT-3' | (SEQ ID NO: 1195)<br>(SEQ ID NO: 3209)<br>(SEQ ID NO: 5223) |
| LDHA-256 Target: | 5'-CCCGACGUGCAUUCCCGAUUCCUtt-3'<br>3'-GCGGGCUGCACGUAAGGGCUAAGGAAA-5'<br>5'-CGCCCGACGTGCATTCCCGATTCCTTT-3' | (SEQ ID NO: 1196)<br>(SEQ ID NO: 3210)<br>(SEQ ID NO: 5224) |
| LDHA-257 Target: | 5'-CCGACGUGCAUUCCCGAUUCCUUtt-3'<br>3'-CGGGCUGCACGUAAGGGCUAAGGAAAA-5'<br>5'-GCCCGACGTGCATTCCCGATTCCTTTT-3' | (SEQ ID NO: 1197)<br>(SEQ ID NO: 3211)<br>(SEQ ID NO: 5225) |
| LDHA-258 Target: | 5'-CGACGUGCAUUCCCGAUUCCUUUtg-3'<br>3'-GGGCUGCACGUAAGGGCUAAGGAAAAC-5'<br>5'-CCCGACGTGCATTCCCGATTCCTTTTG-3' | (SEQ ID NO: 1198)<br>(SEQ ID NO: 3212)<br>(SEQ ID NO: 5226) |
| LDHA-259 Target: | 5'-GACGUGCAUUCCCGAUUCCUUUUgg-3'<br>3'-GGCUGCACGUAAGGGCUAAGGAAAACC-5'<br>5'-CCGACGTGCATTCCCGATTCCTTTTGG-3' | (SEQ ID NO: 1199)<br>(SEQ ID NO: 3213)<br>(SEQ ID NO: 5227) |
| LDHA-260 Target: | 5'-ACGUGCAUUCCCGAUUCCUUUUGgt-3'<br>3'-GCUGCACGUAAGGGCUAAGGAAAACCA-5'<br>5'-CGACGTGCATTCCCGATTCCTTTTGGT-3' | (SEQ ID NO: 1200)<br>(SEQ ID NO: 3214)<br>(SEQ ID NO: 5228) |
| LDHA-261 Target: | 5'-CGUGCAUUCCCGAUUCCUUUUGGtt-3'<br>3'-CUGCACGUAAGGGCUAAGGAAAACCAA-5'<br>5'-GACGTGCATTCCCGATTCCTTTTGGTT-3' | (SEQ ID NO: 1201)<br>(SEQ ID NO: 3215)<br>(SEQ ID NO: 5229) |
| LDHA-262 Target: | 5'-GUGCAUUCCCGAUUCCUUUUGGUtc-3'<br>3'-UGCACGUAAGGGCUAAGGAAAACCAAG-5'<br>5'-ACGTGCATTCCCGATTCCTTTTGGTTC-3' | (SEQ ID NO: 1202)<br>(SEQ ID NO: 3216)<br>(SEQ ID NO: 5230) |
| LDHA-263 Target: | 5'-UGCAUUCCCGAUUCCUUUUGGUUcc-3'<br>3'-GCACGUAAGGGCUAAGGAAAACCAAGG-5'<br>5'-CGTGCATTCCCGATTCCTTTTGGTTCC-3' | (SEQ ID NO: 1203)<br>(SEQ ID NO: 3217)<br>(SEQ ID NO: 5231) |
| LDHA-264 Target: | 5'-GCAUUCCCGAUUCCUUUUGGUUCca-3'<br>3'-CACGUAAGGGCUAAGGAAAACCAAGGU-5'<br>5'-GTGCATTCCCGATTCCTTTTGGTTCCA-3' | (SEQ ID NO: 1204)<br>(SEQ ID NO: 3218)<br>(SEQ ID NO: 5232) |
| LDHA-265 Target: | 5'-CAUUCCCGAUUCCUUUUGGUUCCaa-3'<br>3'-ACGUAAGGGCUAAGGAAAACCAAGGUU-5'<br>5'-TGCATTCCCGATTCCTTTTGGTTCCAA-3' | (SEQ ID NO: 1205)<br>(SEQ ID NO: 3219)<br>(SEQ ID NO: 5233) |
| LDHA-266 Target: | 5'-AUUCCCGAUUCCUUUUGGUUCCAag-3'<br>3'-CGUAAGGGCUAAGGAAAACCAAGGUUC-5'<br>5'-GCATTCCCGATTCCTTTTGGTTCCAAG-3' | (SEQ ID NO: 1206)<br>(SEQ ID NO: 3220)<br>(SEQ ID NO: 5234) |
| LDHA-267 Target: | 5'-UUCCCGAUUCCUUUUGGUUCCAAgt-3'<br>3'-GUAAGGGCUAAGGAAAACCAAGGUUCA-5'<br>5'-CATTCCCGATTCCTTTTGGTTCCAAGT-3' | (SEQ ID NO: 1207)<br>(SEQ ID NO: 3221)<br>(SEQ ID NO: 5235) |
| LDHA-268 Target: | 5'-UCCCGAUUCCUUUUGGUUCCAAGtc-3'<br>3'-UAAGGGCUAAGGAAAACCAAGGUUCAG-5'<br>5'-ATTCCCGATTCCTTTTGGTTCCAAGTC-3' | (SEQ ID NO: 1208)<br>(SEQ ID NO: 3222)<br>(SEQ ID NO: 5236) |
| LDHA-269 Target: | 5'-CCCGAUUCCUUUUGGUUCCAAGUcc-3'<br>3'-AAGGGCUAAGGAAAACCAAGGUUCAGG-5'<br>5'-TTCCCGATTCCTTTTGGTTCCAAGTCC-3' | (SEQ ID NO: 1209)<br>(SEQ ID NO: 3223)<br>(SEQ ID NO: 5237) |
| LDHA-270 Target: | 5'-CCGAUUCCUUUUGGUUCCAAGUCca-3'<br>3'-AGGGCUAAGGAAAACCAAGGUUCAGGU-5'<br>5'-TCCCGATTCCTTTTGGTTCCAAGTCCA-3' | (SEQ ID NO: 1210)<br>(SEQ ID NO: 3224)<br>(SEQ ID NO: 5238) |
| LDHA-271 Target: | 5'-CGAUUCCUUUUGGUUCCAAGUCCaa-3'<br>3'-GGGCUAAGGAAAACCAAGGUUCAGGUU-5'<br>5'-CCCGATTCCTTTTGGTTCCAAGTCCAA-3' | (SEQ ID NO: 1211)<br>(SEQ ID NO: 3225)<br>(SEQ ID NO: 5239) |
| LDHA-272 Target: | 5'-GAUUCCUUUUGGUUCCAAGUCCAat-3'<br>3'-GGCUAAGGAAAACCAAGGUUCAGGUUA-5'<br>5'-CCGATTCCTTTTGGTTCCAAGTCCAAT-3' | (SEQ ID NO: 1212)<br>(SEQ ID NO: 3226)<br>(SEQ ID NO: 5240) |
| LDHA-273 Target: | 5'-AUUCCUUUUGGUUCCAAGUCCAAta-3'<br>3'-GCUAAGGAAAACCAAGGUUCAGGUUAU-5'<br>5'-CGATTCCTTTTGGTTCCAAGTCCAATA-3' | (SEQ ID NO: 1213)<br>(SEQ ID NO: 3227)<br>(SEQ ID NO: 5241) |

TABLE 12-continued

Additional Selected Human Anti-Lactate Dehydrogenase DsiRNA Agents (Asymmetrics)

| | | |
|---|---|---|
| LDHA-274 Target: | 5'-UUCCUUUUGGUUCCAAGUCCAAUat-3'<br>3'-CUAAGGAAAACCAAGGUUCAGGUUAUA-5'<br>5'-GATTCCTTTTGGTTCCAAGTCCAATAT-3' | (SEQ ID NO: 1214)<br>(SEQ ID NO: 3228)<br>(SEQ ID NO: 5242) |
| LDHA-275 Target: | 5'-UCCUUUUGGUUCCAAGUCCAAUAtg-3'<br>3'-UAAGGAAAACCAAGGUUCAGGUUAUAC-5'<br>5'-ATTCCTTTTGGTTCCAAGTCCAATATG-3' | (SEQ ID NO: 1215)<br>(SEQ ID NO: 3229)<br>(SEQ ID NO: 5243) |
| LDHA-276 Target: | 5'-CCUUUUGGUUCCAAGUCCAAUAUGg-3'<br>3'-AAGGAAAACCAAGGUUCAGGUUAUACC-5'<br>5'-TTCCTTTTGGTTCCAAGTCCAATATGG-3' | (SEQ ID NO: 1216)<br>(SEQ ID NO: 3230)<br>(SEQ ID NO: 5244) |
| LDHA-277 Target: | 5'-CUUUUGGUUCCAAGUCCAAUAUGgc-3'<br>3'-AGGAAAACCAAGGUUCAGGUUAUACCG-5'<br>5'-TCCTTTTGGTTCCAAGTCCAATATGGC-3' | (SEQ ID NO: 1217)<br>(SEQ ID NO: 3231)<br>(SEQ ID NO: 5245) |
| LDHA-278 Target: | 5'-UUUUGGUUCCAAGUCCAAUAUGGca-3'<br>3'-GGAAAACCAAGGUUCAGGUUAUACCGU-5'<br>5'-CCTTTTGGTTCCAAGTCCAATATGGCA-3' | (SEQ ID NO: 1218)<br>(SEQ ID NO: 3232)<br>(SEQ ID NO: 5246) |
| LDHA-279 Target: | 5'-UUUGGUUCCAAGUCCAAUAUGGCaa-3'<br>3'-GAAAACCAAGGUUCAGGUUAUACCGUU-5'<br>5'-CTTTTGGTTCCAAGTCCAATATGGCAA-3' | (SEQ ID NO: 1219)<br>(SEQ ID NO: 3233)<br>(SEQ ID NO: 5247) |
| LDHA-280 Target: | 5'-UUGGUUCCAAGUCCAAUAUGGCAac-3'<br>3'-AAAACCAAGGUUCAGGUUAUACCGUUG-5'<br>5'-TTTTGGTTCCAAGTCCAATATGGCAAC-3' | (SEQ ID NO: 1220)<br>(SEQ ID NO: 3234)<br>(SEQ ID NO: 5248) |
| LDHA-281 Target: | 5'-UGGUUCCAAGUCCAAUAUGGCAAct-3'<br>3'-AAACCAAGGUUCAGGUUAUACCGUUGA-5'<br>5'-TTTGGTTCCAAGTCCAATATGGCAACT-3' | (SEQ ID NO: 1221)<br>(SEQ ID NO: 3235)<br>(SEQ ID NO: 5249) |
| LDHA-282 Target: | 5'-GGUUCCAAGUCCAAUAUGGCAACtc-3'<br>3'-AACCAAGGUUCAGGUUAUACCGUUGAG-5'<br>5'-TTGGTTCCAAGTCCAATATGGCAACTC-3' | (SEQ ID NO: 1222)<br>(SEQ ID NO: 3236)<br>(SEQ ID NO: 5250) |
| LDHA-283 Target: | 5'-GUUCCAAGUCCAAUAUGGCAACUct-3'<br>3'-ACCAAGGUUCAGGUUAUACCGUUGAGA-5'<br>5'-TGGTTCCAAGTCCAATATGGCAACTCT-3' | (SEQ ID NO: 1223)<br>(SEQ ID NO: 3237)<br>(SEQ ID NO: 5251) |
| LDHA-284 Target: | 5'-UUCCAAGUCCAAUAUGGCAACUCta-3'<br>3'-CCAAGGUUCAGGUUAUACCGUUGAGAU-5'<br>5'-GGTTCCAAGTCCAATATGGCAACTCTA-3' | (SEQ ID NO: 1224)<br>(SEQ ID NO: 3238)<br>(SEQ ID NO: 5252) |
| LDHA-285 Target: | 5'-UCCAAGUCCAAUAUGGCAACUCUaa-3'<br>3'-CAAGGUUCAGGUUAUACCGUUGAGAUU-5'<br>5'-GTTCCAAGTCCAATATGGCAACTCTAA-3' | (SEQ ID NO: 1225)<br>(SEQ ID NO: 3239)<br>(SEQ ID NO: 5253) |
| LDHA-286 Target: | 5'-CCAAGUCCAAUAUGGCAACUCUAaa-3'<br>3'-AAGGUUCAGGUUAUACCGUUGAGAUUU-5'<br>5'-TTCCAAGTCCAATATGGCAACTCTAAA-3' | (SEQ ID NO: 1226)<br>(SEQ ID NO: 3240)<br>(SEQ ID NO: 5254) |
| LDHA-287 Target: | 5'-CAAGUCCAAUAUGGCAACUCUAAag-3'<br>3'-AGGUUCAGGUUAUACCGUUGAGAUUUC-5'<br>5'-TCCAAGTCCAATATGGCAACTCTAAAG-3' | (SEQ ID NO: 1227)<br>(SEQ ID NO: 3241)<br>(SEQ ID NO: 5255) |
| LDHA-288 Target: | 5'-AAGUCCAAUAUGGCAACUCUAAAgg-3'<br>3'-GGUUCAGGUUAUACCGUUGAGAUUUCC-5'<br>5'-CCAAGTCCAATATGGCAACTCTAAAGG-3' | (SEQ ID NO: 1228)<br>(SEQ ID NO: 3242)<br>(SEQ ID NO: 5256) |
| LDHA-289 Target: | 5'-AGUCCAAUAUGGCAACUCUAAAGga-3'<br>3'-GUUCAGGUUAUACCGUUGAGAUUUCCU-5'<br>5'-CAAGTCCAATATGGCAACTCTAAAGGA-3' | (SEQ ID NO: 1229)<br>(SEQ ID NO: 3243)<br>(SEQ ID NO: 5257) |
| LDHA-290 Target: | 5'-GUCCAAUAUGGCAACUCUAAAGGat-3'<br>3'-UUCAGGUUAUACCGUUGAGAUUUCCUA-5'<br>5'-AAGTCCAATATGGCAACTCTAAAGGAT-3' | (SEQ ID NO: 1230)<br>(SEQ ID NO: 3244)<br>(SEQ ID NO: 5258) |
| LDHA-291 Target: | 5'-UCCAAUAUGGCAACUCUAAAGGAtc-3'<br>3'-UCAGGUUAUACCGUUGAGAUUUCCUAG-5'<br>5'-AGTCCAATATGGCAACTCTAAAGGATC-3' | (SEQ ID NO: 1231)<br>(SEQ ID NO: 3245)<br>(SEQ ID NO: 5259) |
| LDHA-292 Target: | 5'-CCAAUAUGGCAACUCUAAAGGAUca-3'<br>3'-CAGGUUAUACCGUUGAGAUUUCCUAGU-5'<br>5'-GTCCAATATGGCAACTCTAAAGGATCA-3' | (SEQ ID NO: 1232)<br>(SEQ ID NO: 3246)<br>(SEQ ID NO: 5260) |

TABLE 12-continued

Additional Selected Human Anti-Lactate Dehydrogenase DsiRNA Agents (Asymmetrics)

|  |  |  |
|---|---|---|
| LDHA-293 Target: | 5'-CAAUAUGGCAACUCUAAAGGAUCag-3'<br>3'-AGGUUAUACCGUUGAGAUUUCCUAGUC-5'<br>5'-TCCAATATGGCAACTCTAAAGGATCAG-3' | (SEQ ID NO: 1233)<br>(SEQ ID NO: 3247)<br>(SEQ ID NO: 5261) |
| LDHA-294 Target: | 5'-AAUAUGGCAACUCUAAAGGAUCAgc-3'<br>3'-GGUUAUACCGUUGAGAUUUCCUAGUCG-5'<br>5'-CCAATATGGCAACTCTAAAGGATCAGC-3' | (SEQ ID NO: 1234)<br>(SEQ ID NO: 3248)<br>(SEQ ID NO: 5262) |
| LDHA-295 Target: | 5'-AUAUGGCAACUCUAAAGGAUCAGct-3'<br>3'-GUUAUACCGUUGAGAUUUCCUAGUCGA-5'<br>5'-CAATATGGCAACTCTAAAGGATCAGCT-3' | (SEQ ID NO: 1235)<br>(SEQ ID NO: 3249)<br>(SEQ ID NO: 5263) |
| LDHA-296 Target: | 5'-UAUGGCAACUCUAAAGGAUCAGCtg-3'<br>3'-UUAUACCGUUGAGAUUUCCUAGUCGAC-5'<br>5'-AATATGGCAACTCTAAAGGATCAGCTG-3' | (SEQ ID NO: 1236)<br>(SEQ ID NO: 3250)<br>(SEQ ID NO: 5264) |
| LDHA-297 Target: | 5'-AUGGCAACUCUAAAGGAUCAGCUga-3'<br>3'-UAUACCGUUGAGAUUUCCUAGUCGACU-5'<br>5'-ATATGGCAACTCTAAAGGATCAGCTGA-3' | (SEQ ID NO: 1237)<br>(SEQ ID NO: 3251)<br>(SEQ ID NO: 5265) |
| LDHA-298 Target: | 5'-UGGCAACUCUAAAGGAUCAGCUGat-3'<br>3'-AUACCGUUGAGAUUUCCUAGUCGACUA-5'<br>5'-TATGGCAACTCTAAAGGATCAGCTGAT-3' | (SEQ ID NO: 1238)<br>(SEQ ID NO: 3252)<br>(SEQ ID NO: 5266) |
| LDHA-299 Target: | 5'-GGCAACUCUAAAGGAUCAGCUGAtt-3'<br>3'-UACCGUUGAGAUUUCCUAGUCGACUAA-5'<br>5'-ATGGCAACTCTAAAGGATCAGCTGATT-3' | (SEQ ID NO: 1239)<br>(SEQ ID NO: 3253)<br>(SEQ ID NO: 5267) |
| LDHA-300 Target: | 5'-GCAACUCUAAAGGAUCAGCUGAUtt-3'<br>3'-ACCGUUGAGAUUUCCUAGUCGACUAAA-5'<br>5'-TGGCAACTCTAAAGGATCAGCTGATTT-3' | (SEQ ID NO: 1240)<br>(SEQ ID NO: 3254)<br>(SEQ ID NO: 5268) |
| LDHA-301 Target: | 5'-CAACUCUAAAGGAUCAGCUGAUUta-3'<br>3'-CCGUUGAGAUUUCCUAGUCGACUAAAU-5'<br>5'-GGCAACTCTAAAGGATCAGCTGATTTA-3' | (SEQ ID NO: 1241)<br>(SEQ ID NO: 3255)<br>(SEQ ID NO: 5269) |
| LDHA-302 Target: | 5'-AACUCUAAAGGAUCAGCUGAUUUat-3'<br>3'-CGUUGAGAUUUCCUAGUCGACUAAAUA-5'<br>5'-GCAACTCTAAAGGATCAGCTGATTTAT-3' | (SEQ ID NO: 1242)<br>(SEQ ID NO: 3256)<br>(SEQ ID NO: 5270) |
| LDHA-303 Target: | 5'-ACUCUAAAGGAUCAGCUGAUUUAta-3'<br>3'-GUUGAGAUUUCCUAGUCGACUAAAUAU-5'<br>5'-CAACTCTAAAGGATCAGCTGATTTATA-3' | (SEQ ID NO: 1243)<br>(SEQ ID NO: 3257)<br>(SEQ ID NO: 5271) |
| LDHA-304 Target: | 5'-CUCUAAAGGAUCAGCUGAUUUAUaa-3'<br>3'-UUGAGAUUUCCUAGUCGACUAAAUAUU-5'<br>5'-AACTCTAAAGGATCAGCTGATTTATAA-3' | (SEQ ID NO: 1244)<br>(SEQ ID NO: 3258)<br>(SEQ ID NO: 5272) |
| LDHA-305 Target: | 5'-UCUAAAGGAUCAGCUGAUUUAUAat-3'<br>3'-UGAGAUUUCCUAGUCGACUAAAUAUUA-5'<br>5'-ACTCTAAAGGATCAGCTGATTTATAAT-3' | (SEQ ID NO: 1245)<br>(SEQ ID NO: 3259)<br>(SEQ ID NO: 5273) |
| LDHA-306 Target: | 5'-CUAAAGGAUCAGCUGAUUUAUAAtc-3'<br>3'-GAGAUUUCCUAGUCGACUAAAUAUUAG-5'<br>5'-CTCTAAAGGATCAGCTGATTTATAATC-3' | (SEQ ID NO: 1246)<br>(SEQ ID NO: 3260)<br>(SEQ ID NO: 5274) |
| LDHA-307 Target: | 5'-UAAAGGAUCAGCUGAUUUAUAAUct-3'<br>3'-AGAUUUCCUAGUCGACUAAAUAUUAGA-5'<br>5'-TCTAAAGGATCAGCTGATTTATAATCT-3' | (SEQ ID NO: 1247)<br>(SEQ ID NO: 3261)<br>(SEQ ID NO: 5275) |
| LDHA-308 Target: | 5'-AAAGGAUCAGCUGAUUUAUAAUCtt-3'<br>3'-GAUUUCCUAGUCGACUAAAUAUUAGAA-5'<br>5'-CTAAAGGATCAGCTGATTTATAATCTT-3' | (SEQ ID NO: 1248)<br>(SEQ ID NO: 3262)<br>(SEQ ID NO: 5276) |
| LDHA-309 Target: | 5'-AAGGAUCAGCUGAUUUAUAAUCUtc-3'<br>3'-AUUUCCUAGUCGACUAAAUAUUAGAAG-5'<br>5'-TAAAGGATCAGCTGATTTATAATCTTC-3' | (SEQ ID NO: 1249)<br>(SEQ ID NO: 3263)<br>(SEQ ID NO: 5277) |
| LDHA-310 Target: | 5'-AGGAUCAGCUGAUUUAUAAUCUUct-3'<br>3'-UUUCCUAGUCGACUAAAUAUUAGAAGA-5'<br>5'-AAAGGATCAGCTGATTTATAATCTTCT-3' | (SEQ ID NO: 1250)<br>(SEQ ID NO: 3264)<br>(SEQ ID NO: 5278) |
| LDHA-311 Target: | 5'-GGAUCAGCUGAUUUAUAAUCUUCta-3'<br>3'-UUCCUAGUCGACUAAAUAUUAGAAGAU-5'<br>5'-AAGGATCAGCTGATTTATAATCTTCTA-3' | (SEQ ID NO: 1251)<br>(SEQ ID NO: 3265)<br>(SEQ ID NO: 5279) |

TABLE 12-continued

Additional Selected Human Anti-Lactate Dehydrogenase DsiRNA Agents (Asymmetrics)

| | | | |
|---|---|---|---|
| | 5'-GA<u>C</u>AGCUGAUUUA<u>U</u>A<u>U</u>AUCUUCUaa-3' | (SEQ ID NO: 1252) | |
| | 3'-<u>UCCU</u>AGUCGACUAAA<u>U</u>AUUAGAAGA<u>U</u>UU-5' | (SEQ ID NO: 3266) | |
| LDHA-312 Target: | 5'-AGGATCAGCTGATTTATAATCTTCTAA-3' | (SEQ ID NO: 5280) | |
| | 5'-A<u>U</u>CAGCUGAUUUA<u>U</u>A<u>A</u>UCUUCUAaa-3' | (SEQ ID NO: 1253) | |
| | 3'-<u>CCU</u>AGUCGACUAAA<u>U</u>A<u>U</u>UAGAAGA<u>U</u>UU-5' | (SEQ ID NO: 3267) | |
| LDHA-313 Target: | 5'-GGATCAGCTGATTTATAATCTTCTAAA-3' | (SEQ ID NO: 5281) | |
| | 5'-U<u>C</u>AGCUGAUUUAU<u>A</u>A<u>U</u>CUUCUAAag-3' | (SEQ ID NO: 1254) | |
| | 3'-<u>CUAG</u>UCGACUAAAU<u>A</u>U<u>U</u>AGAAGA<u>UUUC</u>-5' | (SEQ ID NO: 3268) | |
| LDHA-314 Target: | 5'-GATCAGCTGATTTATAATCTTCTAAAG-3' | (SEQ ID NO: 5282) | |
| | 5'-C<u>A</u>GCUGAUUUAUA<u>A</u>U<u>C</u>UUCUAAAgg-3' | (SEQ ID NO: 1255) | |
| | 3'-<u>U</u>AG<u>U</u>CGACUAAAU<u>A</u>UUAGAAGAU<u>UUCC</u>-5' | (SEQ ID NO: 3269) | |
| LDHA-315 Target: | 5'-ATCAGCTGATTTATAATCTTCTAAAGG-3' | (SEQ ID NO: 5283) | |
| | 5'-A<u>G</u>CUGAUUUAUAA<u>U</u>C<u>U</u>UCUAAAGga-3' | (SEQ ID NO: 1256) | |
| | 3'-<u>A</u>GU<u>C</u>GACUAAAU<u>A</u>UUAGAAGAUUU<u>CCU</u>-5' | (SEQ ID NO: 3270) | |
| LDHA-316 Target: | 5'-TCAGCTGATTTATAATCTTCTAAAGGA-3' | (SEQ ID NO: 5284) | |
| | 5'-GC<u>U</u>GAUUUAUAAUC<u>U</u>UCUAAAGGaa-3' | (SEQ ID NO: 1257) | |
| | 3'-<u>GU</u>C<u>G</u>ACUAAAUAU<u>U</u>AGAAGAUUU<u>CCUU</u>-5' | (SEQ ID NO: 3271) | |
| LDHA-317 Target: | 5'-CAGCTGATTTATAATCTTCTAAAGGAA-3' | (SEQ ID NO: 5285) | |
| | 5'-C<u>U</u>GAUUUAUAAUC<u>UU</u>CUAAAGGAag-3' | (SEQ ID NO: 1258) | |
| | 3'-<u>UCGA</u>CUAAAUAUUAGAAGAUUU<u>CCUUC</u>-5' | (SEQ ID NO: 3272) | |
| LDHA-318 Target: | 5'-AGCTGATTTATAATCTTCTAAAGGAAG-3' | (SEQ ID NO: 5286) | |
| | 5'-UGA<u>U</u>UUAUAAUC<u>U</u>UCUAAAGGAAga-3' | (SEQ ID NO: 1259) | |
| | 3'-<u>CGA</u>CUAAAUAUUAGA<u>A</u>GAUUUCC<u>UUCU</u>-5' | (SEQ ID NO: 3273) | |
| LDHA-319 Target: | 5'-GCTGATTTATAATCTTCTAAAGGAAGA-3' | (SEQ ID NO: 5287) | |
| | 5'-GA<u>U</u>UUAUAAUC<u>U</u>CUAAAGGAAGaa-3' | (SEQ ID NO: 1260) | |
| | 3'-<u>GACU</u>AAAUAUUAGA<u>A</u>GAUUUCC<u>UUCUU</u>-5' | (SEQ ID NO: 3274) | |
| LDHA-320 Target: | 5'-CTGATTTATAATCTTCTAAAGGAAGAA-3' | (SEQ ID NO: 5288) | |
| | 5'-A<u>U</u>UUAUAAUCUUC<u>U</u>AAAGGAAGAac-3' | (SEQ ID NO: 1261) | |
| | 3'-<u>AC</u>UAAAUAUUAGAA<u>G</u>AUUUCCUU<u>CUUG</u>-5' | (SEQ ID NO: 3275) | |
| LDHA-321 Target: | 5'-TGATTTATAATCTTCTAAAGGAAGAAC-3' | (SEQ ID NO: 5289) | |
| | 5'-U<u>U</u>UAUAAUCUUCU<u>AA</u>AGGAAGAAca-3' | (SEQ ID NO: 1262) | |
| | 3'-<u>CU</u>AAAUAUUAGAAG<u>A</u>UUUCCUUC<u>UUGU</u>-5' | (SEQ ID NO: 3276) | |
| LDHA-322 Target: | 5'-GATTTATAATCTTCTAAAGGAAGAACA-3' | (SEQ ID NO: 5290) | |
| | 5'-UU<u>U</u>AUAAUCUUCUA<u>A</u>AGGAAGAACag-3' | (SEQ ID NO: 1263) | |
| | 3'-<u>U</u>AA<u>A</u>UAUUAGAAGA<u>U</u>UUCCUUC<u>UUGUC</u>-5' | (SEQ ID NO: 3277) | |
| LDHA-323 Target: | 5'-ATTTATAATCTTCTAAAGGAAGAACAG-3' | (SEQ ID NO: 5291) | |
| | 5'-U<u>A</u>U<u>A</u>AUCUUCUAA<u>A</u>GGAAGAACAga-3' | (SEQ ID NO: 1264) | |
| | 3'-<u>AAA</u>UAUUAGAAGAUUUCCUUC<u>UUGUCU</u>-5' | (SEQ ID NO: 3278) | |
| LDHA-324 Target: | 5'-TTTATAATCTTCTAAAGGAAGAACAGA-3' | (SEQ ID NO: 5292) | |
| | 5'-A<u>U</u>A<u>A</u>UCUUCUAAA<u>GG</u>AAGAACAGac-3' | (SEQ ID NO: 1265) | |
| | 3'-<u>AA</u>UAUUAGAAGAUUU<u>CC</u>UUCUUGU<u>CUG</u>-5' | (SEQ ID NO: 3279) | |
| LDHA-325 Target: | 5'-TTATAATCTTCTAAAGGAAGAACAGAC-3' | (SEQ ID NO: 5293) | |
| | 5'-U<u>AA</u>UCUUCUAAAGG<u>A</u>AGAACAGAcc-3' | (SEQ ID NO: 1266) | |
| | 3'-<u>A</u>UAUUAGAAGAUUU<u>CC</u>UUCUUGU<u>CUGG</u>-5' | (SEQ ID NO: 3280) | |
| LDHA-326 Target: | 5'-TATAATCTTCTAAAGGAAGAACAGACC-3' | (SEQ ID NO: 5294) | |
| | 5'-AA<u>U</u>CUUCUAAAGG<u>A</u>AGAACAGACcc-3' | (SEQ ID NO: 1267) | |
| | 3'-<u>U</u>AUUAGAAGAUUU<u>CC</u>UUCUUGU<u>CUGGG</u>-5' | (SEQ ID NO: 3281) | |
| LDHA-327 Target: | 5'-ATAATCTTCTAAAGGAAGAACAGACCC-3' | (SEQ ID NO: 5295) | |
| | 5'-A<u>U</u>CUUCUAAAGGA<u>A</u>GAACAGACCcc-3' | (SEQ ID NO: 1268) | |
| | 3'-<u>A</u>UUAGAAGAUUUCC<u>UU</u>CUUGUCU<u>GGGG</u>-5' | (SEQ ID NO: 3282) | |
| LDHA-328 Target: | 5'-TAATCTTCTAAAGGAAGAACAGACCCC-3' | (SEQ ID NO: 5296) | |
| | 5'-U<u>C</u>UUCUAAAGGAAG<u>AA</u>CAGACCCcc-3' | (SEQ ID NO: 1269) | |
| | 3'-<u>UU</u>AGAAGAUUUCCUU<u>C</u>UUGUCU<u>GGGGG</u>-5' | (SEQ ID NO: 3283) | |
| LDHA-329 Target: | 5'-AATCTTCTAAAGGAAGAACAGACCCCC-3' | (SEQ ID NO: 5297) | |
| | 5'-C<u>UU</u>CUAAAGGAAG<u>AA</u>CAGACCCCcc-3' | (SEQ ID NO: 1270) | |
| | 3'-<u>UAGAA</u>GAUUUCC<u>UU</u>C<u>U</u>UGUCU<u>GGGGG</u>-5' | (SEQ ID NO: 3284) | |
| LDHA-330 Target: | 5'-ATCTTCTAAAGGAAGAACAGACCCCCC-3' | (SEQ ID NO: 5298) | |

TABLE 12-continued

Additional Selected Human Anti-Lactate Dehydrogenase DsiRNA Agents (Asymmetrics)

| | | |
|---|---|---|
| LDHA-331 Target: | 5'-UUCUAAAGGAAGAACAGACCCCCca-3'<br>3'-AGAAGAUUUCCUUCUUGUCUGGGGGGU-5'<br>5'-TCTTCTAAAGGAAGAACAGACCCCCCA-3' | (SEQ ID NO: 1271)<br>(SEQ ID NO: 3285)<br>(SEQ ID NO: 5299) |
| LDHA-332 Target: | 5'-UCUAAAGGAAGAACAGACCCCCCag-3'<br>3'-GAAGAUUUCCUUCUUGUCUGGGGGGUC-5'<br>5'-CTTCTAAAGGAAGAACAGACCCCCCAG-3' | (SEQ ID NO: 1272)<br>(SEQ ID NO: 3286)<br>(SEQ ID NO: 5300) |
| LDHA-333 Target: | 5'-CUAAAGGAAGAACAGACCCCCCAga-3'<br>3'-AAGAUUUCCUUCUUGUCUGGGGGGUCU-5'<br>5'-TTCTAAAGGAAGAACAGACCCCCCAGA-3' | (SEQ ID NO: 1273)<br>(SEQ ID NO: 3287)<br>(SEQ ID NO: 5301) |
| LDHA-334 Target: | 5'-UAAAGGAAGAACAGACCCCCCAGaa-3'<br>3'-AGAUUUCCUUCUUGUCUGGGGGGUCUU-5'<br>5'-TCTAAAGGAAGAACAGACCCCCCAGAA-3' | (SEQ ID NO: 1274)<br>(SEQ ID NO: 3288)<br>(SEQ ID NO: 5302) |
| LDHA-335 Target: | 5'-AAAGGAAGAACAGACCCCCCAGAat-3'<br>3'-GAUUUCCUUCUUGUCUGGGGGGUCUUA-5'<br>5'-CTAAAGGAAGAACAGACCCCCCAGAAT-3' | (SEQ ID NO: 1275)<br>(SEQ ID NO: 3289)<br>(SEQ ID NO: 5303) |
| LDHA-336 Target: | 5'-AAGGAAGAACAGACCCCCCAGAAta-3'<br>3'-AUUUCCUUCUUGUCUGGGGGGUCUUAU-5'<br>5'-TAAAGGAAGAACAGACCCCCCAGAATA-3' | (SEQ ID NO: 1276)<br>(SEQ ID NO: 3290)<br>(SEQ ID NO: 5304) |
| LDHA-337 Target: | 5'-AGGAAGAACAGACCCCCCAGAAUaa-3'<br>3'-UUUCCUUCUUGUCUGGGGGGUCUUAUU-5'<br>5'-AAAGGAAGAACAGACCCCCCAGAATAA-3' | (SEQ ID NO: 1277)<br>(SEQ ID NO: 3291)<br>(SEQ ID NO: 5305) |
| LDHA-338 Target: | 5'-GGAAGAACAGACCCCCCAGAAUAag-3'<br>3'-UUCCUUCUUGUCUGGGGGGUCUUAUUC-5'<br>5'-AAGGAAGAACAGACCCCCCAGAATAAG-3' | (SEQ ID NO: 1278)<br>(SEQ ID NO: 3292)<br>(SEQ ID NO: 5306) |
| LDHA-339 Target: | 5'-GAAGAACAGACCCCCCAGAAUAAga-3'<br>3'-UCCUUCUUGUCUGGGGGGUCUUAUUCU-5'<br>5'-AGGAAGAACAGACCCCCCAGAATAAGA-3' | (SEQ ID NO: 1279)<br>(SEQ ID NO: 3293)<br>(SEQ ID NO: 5307) |
| LDHA-340 Target: | 5'-AAGAACAGACCCCCCAGAAUAAGat-3'<br>3'-CCUUCUUGUCUGGGGGGUCUUAUUCUA-5'<br>5'-GGAAGAACAGACCCCCCAGAATAAGAT-3' | (SEQ ID NO: 1280)<br>(SEQ ID NO: 3294)<br>(SEQ ID NO: 5308) |
| LDHA-341 Target: | 5'-AGAACAGACCCCCCAGAAUAAGAtt-3'<br>3'-CUUCUUGUCUGGGGGGUCUUAUUCUAA-5'<br>5'-GAAGAACAGACCCCCCAGAATAAGATT-3' | (SEQ ID NO: 1281)<br>(SEQ ID NO: 3295)<br>(SEQ ID NO: 5309) |
| LDHA-342 Target: | 5'-GAACAGACCCCCCAGAAUAAGAUta-3'<br>3'-UUCUUGUCUGGGGGGUCUUAUUCUAAU-5'<br>5'-AAGAACAGACCCCCCAGAATAAGATTA-3' | (SEQ ID NO: 1282)<br>(SEQ ID NO: 3296)<br>(SEQ ID NO: 5310) |
| LDHA-343 Target: | 5'-AACAGACCCCCCAGAAUAAGAUUac-3'<br>3'-UCUUGUCUGGGGGGUCUUAUUCUAAUG-5'<br>5'-AGAACAGACCCCCCAGAATAAGATTAC-3' | (SEQ ID NO: 1283)<br>(SEQ ID NO: 3297)<br>(SEQ ID NO: 5311) |
| LDHA-344 Target: | 5'-ACAGACCCCCCAGAAUAAGAUUAca-3'<br>3'-CUUGUCUGGGGGGUCUUAUUCUAAUGU-5'<br>5'-GAACAGACCCCCCAGAATAAGATTACA-3' | (SEQ ID NO: 1284)<br>(SEQ ID NO: 3298)<br>(SEQ ID NO: 5312) |
| LDHA-345 Target: | 5'-CAGACCCCCCAGAAUAAGAUUACag-3'<br>3'-UUGUCUGGGGGGUCUUAUUCUAAUGUC-5'<br>5'-AACAGACCCCCCAGAATAAGATTACAG-3' | (SEQ ID NO: 1285)<br>(SEQ ID NO: 3299)<br>(SEQ ID NO: 5313) |
| LDHA-346 Target: | 5'-AGACCCCCCAGAAUAAGAUUACAgt-3'<br>3'-UGUCUGGGGGGUCUUAUUCUAAUGUCA-5'<br>5'-ACAGACCCCCCAGAATAAGATTACAGT-3' | (SEQ ID NO: 1286)<br>(SEQ ID NO: 3300)<br>(SEQ ID NO: 5314) |
| LDHA-347 Target: | 5'-GACCCCCCAGAAUAAGAUUACAGtt-3'<br>3'-GUCUGGGGGGUCUUAUUCUAAUGUCAA-5'<br>5'-CAGACCCCCCAGAATAAGATTACAGTT-3' | (SEQ ID NO: 1287)<br>(SEQ ID NO: 3301)<br>(SEQ ID NO: 5315) |
| LDHA-348 Target: | 5'-ACCCCCCAGAAUAAGAUUACAGUtg-3'<br>3'-UCUGGGGGGUCUUAUUCUAAUGUCAAC-5'<br>5'-AGACCCCCCAGAATAAGATTACAGTTG-3' | (SEQ ID NO: 1288)<br>(SEQ ID NO: 3302)<br>(SEQ ID NO: 5316) |
| LDHA-349 Target: | 5'-CCCCCCAGAAUAAGAUUACAGUUgt-3'<br>3'-CUGGGGGGUCUUAUUCUAAUGUCAACA-5'<br>5'-GACCCCCCAGAATAAGATTACAGTTGT-3' | (SEQ ID NO: 1289)<br>(SEQ ID NO: 3303)<br>(SEQ ID NO: 5317) |

TABLE 12-continued

Additional Selected Human Anti-Lactate Dehydrogenase DsiRNA Agents (Asymmetrics)

| | | |
|---|---|---|
| LDHA-350 Target: | 5'-CCCCCAGAAUAAGAUUACAGUUGtt-3'<br>3'-UGGGGGGUCUUAUUCUAAUGUCAACAA-5'<br>5'-ACCCCCCAGAATAAGATTACAGTTGTT-3' | (SEQ ID NO: 1290)<br>(SEQ ID NO: 3304)<br>(SEQ ID NO: 5318) |
| LDHA-351 Target: | 5'-CCCCAGAAUAAGAUUACAGUUGtg-3'<br>3'-GGGGGGUCUUAUUCUAAUGUCAACAAC-5'<br>5'-CCCCCCAGAATAAGATTACAGTTGTTG-3' | (SEQ ID NO: 1291)<br>(SEQ ID NO: 3305)<br>(SEQ ID NO: 5319) |
| LDHA-352 Target: | 5'-CCCAGAAUAAGAUUACAGUUGUUgg-3'<br>3'-GGGGGUCUUAUUCUAAUGUCAACAACC-5'<br>5'-CCCCCAGAATAAGATTACAGTTGTTGG-3' | (SEQ ID NO: 1292)<br>(SEQ ID NO: 3306)<br>(SEQ ID NO: 5320) |
| LDHA-353 Target: | 5'-CCAGAAUAAGAUUACAGUUGUUGgg-3'<br>3'-GGGGUCUUAUUCUAAUGUCAACAACCC-5'<br>5'-CCCCAGAATAAGATTACAGTTGTTGGG-3' | (SEQ ID NO: 1293)<br>(SEQ ID NO: 3307)<br>(SEQ ID NO: 5321) |
| LDHA-354 Target: | 5'-CAGAAUAAGAUUACAGUUGUUGGgg-3'<br>3'-GGGUCUUAUUCUAAUGUCAACAACCCC-5'<br>5'-CCCAGAATAAGATTACAGTTGTTGGGG-3' | (SEQ ID NO: 1294)<br>(SEQ ID NO: 3308)<br>(SEQ ID NO: 5322) |
| LDHA-357 Target: | 5'-AAUAAGAUUACAGUUGUUGGGGGUtg-3'<br>3'-UCUUAUUCUAAUGUCAACAACCCCCAAC-5'<br>5'-AGAATAAGATTACAGTTGTTGGGGTTG-3' | (SEQ ID NO: 1295)<br>(SEQ ID NO: 3309)<br>(SEQ ID NO: 5323) |
| LDHA-358 Target: | 5'-AUAAGAUUACAGUUGUUGGGGUUgg-3'<br>3'-CUUAUUCUAAUGUCAACAACCCCAACC-5'<br>5'-GAATAAGATTACAGTTGTTGGGGTTGG-3' | (SEQ ID NO: 1296)<br>(SEQ ID NO: 3310)<br>(SEQ ID NO: 5324) |
| LDHA-359 Target: | 5'-UAAGAUUACAGUUGUUGGGGUUGgt-3'<br>3'-UUAUUCUAAUGUCAACAACCCCAACCA-5'<br>5'-AATAAGATTACAGTTGTTGGGGTTGGT-3' | (SEQ ID NO: 1297)<br>(SEQ ID NO: 3311)<br>(SEQ ID NO: 5325) |
| LDHA-368 Target: | 5'-AGUUGUUGGGGUUGGUGCUGUUGgc-3'<br>3'-UGUCAACAACCCCAACCACGACAACCG-5'<br>5'-ACAGTTGTTGGGGTTGGTGCTGTTGGC-3' | (SEQ ID NO: 1298)<br>(SEQ ID NO: 3312)<br>(SEQ ID NO: 5326) |
| LDHA-371 Target: | 5'-UGUUGGGGUUGGUGCUGUUGGCAtg-3'<br>3'-CAACAACCCCAACCACGACAACCGUAC-5'<br>5'-GTTGTTGGGGTTGGTGCTGTTGGCATG-3' | (SEQ ID NO: 1299)<br>(SEQ ID NO: 3313)<br>(SEQ ID NO: 5327) |
| LDHA-372 Target: | 5'-GUUGGGGUUGGUGCUGUUGGCAUgg-3'<br>3'-AACAACCCCAACCACGACAACCGUACC-5'<br>5'-TTGTTGGGGTTGGTGCTGTTGGCATGG-3' | (SEQ ID NO: 1300)<br>(SEQ ID NO: 3314)<br>(SEQ ID NO: 5328) |
| LDHA-373 Target: | 5'-UUGGGGUUGGUGCUGUUGGCAUGgc-3'<br>3'-ACAACCCCAACCACGACAACCGUACCG-5'<br>5'-TGTTGGGGTTGGTGCTGTTGGCATGGC-3' | (SEQ ID NO: 1301)<br>(SEQ ID NO: 3315)<br>(SEQ ID NO: 5329) |
| LDHA-374 Target: | 5'-UGGGGUUGGUGCUGUUGGCAUGGcc-3'<br>3'-CAACCCCAACCACGACAACCGUACCGG-5'<br>5'-GTTGGGGTTGGTGCTGTTGGCATGGCC-3' | (SEQ ID NO: 1302)<br>(SEQ ID NO: 3316)<br>(SEQ ID NO: 5330) |
| LDHA-375 Target: | 5'-GGGGUUGGUGCUGUUGGCAUGGCct-3'<br>3'-AACCCCAACCACGACAACCGUACCGGA-5'<br>5'-TTGGGGTTGGTGCTGTTGGCATGGCCT-3' | (SEQ ID NO: 1303)<br>(SEQ ID NO: 3317)<br>(SEQ ID NO: 5331) |
| LDHA-376 Target: | 5'-GGGUUGGUGCUGUUGGCAUGGCCtg-3'<br>3'-ACCCCAACCACGACAACCGUACCGGAC-5'<br>5'-TGGGGTTGGTGCTGTTGGCATGGCCTG-3' | (SEQ ID NO: 1304)<br>(SEQ ID NO: 3318)<br>(SEQ ID NO: 5332) |
| LDHA-377 Target: | 5'-GGUUGGUGCUGUUGGCAUGGCCUgt-3'<br>3'-CCCCAACCACGACAACCGUACCGGACA-5'<br>5'-GGGGTTGGTGCTGTTGGCATGGCCTGT-3' | (SEQ ID NO: 1305)<br>(SEQ ID NO: 3319)<br>(SEQ ID NO: 5333) |
| LDHA-378 Target: | 5'-GUUGGUGCUGUUGGCAUGGCCUGtg-3'<br>3'-CCCAACCACGACAACCGUACCGGACAC-5'<br>5'-GGGTTGGTGCTGTTGGCATGGCCTGTG-3' | (SEQ ID NO: 1306)<br>(SEQ ID NO: 3320)<br>(SEQ ID NO: 5334) |
| LDHA-379 Target: | 5'-UUGGUGCUGUUGGCAUGGCCUGUgc-3'<br>3'-CCAACCACGACAACCGUACCGGACACG-5'<br>5'-GGTTGGTGCTGTTGGCATGGCCTGTGC-3' | (SEQ ID NO: 1307)<br>(SEQ ID NO: 3321)<br>(SEQ ID NO: 5335) |
| LDHA-380 Target: | 5'-UGGUGCUGUUGGCAUGGCCUGUGcc-3'<br>3'-CAACCACGACAACCGUACCGGACACGG-5'<br>5'-GTTGGTGCTGTTGGCATGGCCTGTGCC-3' | (SEQ ID NO: 1308)<br>(SEQ ID NO: 3322)<br>(SEQ ID NO: 5336) |

TABLE 12-continued

Additional Selected Human Anti-Lactate Dehydrogenase DsiRNA Agents (Asymmetrics)

|  |  |  |
|---|---|---|
| LDHA-381 Target: | 5'-GGUGCUGUUGGCAUGGCCUGUGCca-3'<br>3'-AACCACGACAACCGUACCGGACACGGU-5'<br>5'-TTGGTGCTGTTGGCATGGCCTGTGCCA-3' | (SEQ ID NO: 1309)<br>(SEQ ID NO: 3323)<br>(SEQ ID NO: 5337) |
| LDHA-382 Target: | 5'-GUGCUGUUGGCAUGGCCUGUGCCat-3'<br>3'-ACCACGACAACCGUACCGGACACGGUA-5'<br>5'-TGGTGCTGTTGGCATGGCCTGTGCCAT-3' | (SEQ ID NO: 1310)<br>(SEQ ID NO: 3324)<br>(SEQ ID NO: 5338) |
| LDHA-383 Target: | 5'-UGCUGUUGGCAUGGCCUGUGCCAtc-3'<br>3'-CCACGACAACCGUACCGGACACGGUAG-5'<br>5'-GGTGCTGTTGGCATGGCCTGTGCCATC-3' | (SEQ ID NO: 1311)<br>(SEQ ID NO: 3325)<br>(SEQ ID NO: 5339) |
| LDHA-384 Target: | 5'-GCUGUUGGCAUGGCCUGUGCCAUca-3'<br>3'-CACGACAACCGUACCGGACACGGUAGU-5'<br>5'-GTGCTGTTGGCATGGCCTGTGCCATCA-3' | (SEQ ID NO: 1312)<br>(SEQ ID NO: 3326)<br>(SEQ ID NO: 5340) |
| LDHA-385 Target: | 5'-CUGUUGGCAUGGCCUGUGCCAUCag-3'<br>3'-ACGACAACCGUACCGGACACGGUAGUC-5'<br>5'-TGCTGTTGGCATGGCCTGTGCCATCAG-3' | (SEQ ID NO: 1313)<br>(SEQ ID NO: 3327)<br>(SEQ ID NO: 5341) |
| LDHA-386 Target: | 5'-UGUUGGCAUGGCCUGUGCCAUCAgt-3'<br>3'-CGACAACCGUACCGGACACGGUAGUCA-5'<br>5'-GCTGTTGGCATGGCCTGTGCCATCAGT-3' | (SEQ ID NO: 1314)<br>(SEQ ID NO: 3328)<br>(SEQ ID NO: 5342) |
| LDHA-387 Target: | 5'-GUUGGCAUGGCCUGUGCCAUCAGta-3'<br>3'-GACAACCGUACCGGACACGGUAGUCAU-5'<br>5'-CTGTTGGCATGGCCTGTGCCATCAGTA-3' | (SEQ ID NO: 1315)<br>(SEQ ID NO: 3329)<br>(SEQ ID NO: 5343) |
| LDHA-388 Target: | 5'-UUGGCAUGGCCUGUGCCAUCAGUat-3'<br>3'-ACAACCGUACCGGACACGGUAGUCAUA-5'<br>5'-TGTTGGCATGGCCTGTGCCATCAGTAT-3' | (SEQ ID NO: 1316)<br>(SEQ ID NO: 3330)<br>(SEQ ID NO: 5344) |
| LDHA-389 Target: | 5'-UGGCAUGGCCUGUGCCAUCAGUAtc-3'<br>3'-CAACCGUACCGGACACGGUAGUCAUAG-5'<br>5'-GTTGGCATGGCCTGTGCCATCAGTATC-3' | (SEQ ID NO: 1317)<br>(SEQ ID NO: 3331)<br>(SEQ ID NO: 5345) |
| LDHA-390 Target: | 5'-GGCAUGGCCUGUGCCAUCAGUAUct-3'<br>3'-AACCGUACCGGACACGGUAGUCAUAGA-5'<br>5'-TTGGCATGGCCTGTGCCATCAGTATCT-3' | (SEQ ID NO: 1318)<br>(SEQ ID NO: 3332)<br>(SEQ ID NO: 5346) |
| LDHA-391 Target: | 5'-GCAUGGCCUGUGCCAUCAGUAUCtt-3'<br>3'-ACCGUACCGGACACGGUAGUCAUAGAA-5'<br>5'-TGGCATGGCCTGTGCCATCAGTATCTT-3' | (SEQ ID NO: 1319)<br>(SEQ ID NO: 3333)<br>(SEQ ID NO: 5347) |
| LDHA-392 Target: | 5'-CAUGGCCUGUGCCAUCAGUAUCUta-3'<br>3'-CCGUACCGGACACGGUAGUCAUAGAAU-5'<br>5'-GGCATGGCCTGTGCCATCAGTATCTTA-3' | (SEQ ID NO: 1320)<br>(SEQ ID NO: 3334)<br>(SEQ ID NO: 5348) |
| LDHA-393 Target: | 5'-AUGGCCUGUGCCAUCAGUAUCUUaa-3'<br>3'-CGUACCGGACACGGUAGUCAUAGAAUU-5'<br>5'-GCATGGCCTGTGCCATCAGTATCTTAA-3' | (SEQ ID NO: 1321)<br>(SEQ ID NO: 3335)<br>(SEQ ID NO: 5349) |
| LDHA-394 Target: | 5'-UGGCCUGUGCCAUCAGUAUCUUAat-3'<br>3'-GUACCGGACACGGUAGUCAUAGAAUUA-5'<br>5'-CATGGCCTGTGCCATCAGTATCTTAAT-3' | (SEQ ID NO: 1322)<br>(SEQ ID NO: 3336)<br>(SEQ ID NO: 5350) |
| LDHA-395 Target: | 5'-GGCCUGUGCCAUCAGUAUCUUAAtg-3'<br>3'-UACCGGACACGGUAGUCAUAGAAUUAC-5'<br>5'-ATGGCCTGTGCCATCAGTATCTTAATG-3' | (SEQ ID NO: 1323)<br>(SEQ ID NO: 3337)<br>(SEQ ID NO: 5351) |
| LDHA-396 Target: | 5'-GCCUGUGCCAUCAGUAUCUUAAUga-3'<br>3'-ACCGGACACGGUAGUCAUAGAAUUACU-5'<br>5'-TGGCCTGTGCCATCAGTATCTTAATGA-3' | (SEQ ID NO: 1324)<br>(SEQ ID NO: 3338)<br>(SEQ ID NO: 5352) |
| LDHA-405 Target: | 5'-AUCAGUAUCUUAAUGAAGGACUUgg-3'<br>3'-GGUAGUCAUAGAAUUACUUCCUGAACC-5'<br>5'-CCATCAGTATCTTAATGAAGGACTTGG-3' | (SEQ ID NO: 1325)<br>(SEQ ID NO: 3339)<br>(SEQ ID NO: 5353) |
| LDHA-406 Target: | 5'-UCAGUAUCUUAAUGAAGGACUUGgc-3'<br>3'-GUAGUCAUAGAAUUACUUCCUGAACCG-5'<br>5'-CATCAGTATCTTAATGAAGGACTTGGC-3' | (SEQ ID NO: 1326)<br>(SEQ ID NO: 3340)<br>(SEQ ID NO: 5354) |
| LDHA-407 Target: | 5'-CAGUAUCUUAAUGAAGGACUUGGca-3'<br>3'-UAGUCAUAGAAUUACUUCCUGAACCGU-5'<br>5'-ATCAGTATCTTAATGAAGGACTTGGCA-3' | (SEQ ID NO: 1327)<br>(SEQ ID NO: 3341)<br>(SEQ ID NO: 5355) |

TABLE 12-continued

Additional Selected Human Anti-Lactate Dehydrogenase DsiRNA Agents (Asymmetrics)

| | | |
|---|---|---|
| LDHA-408 Target: | 5'-AGUAUCUUAAUGAAGGACUUGGCag-3'<br>3'-AGUCAUAGAAUUACUUCCUGAACCGUC-5'<br>5'-TCAGTATCTTAATGAAGGACTTGGCAG-3' | (SEQ ID NO: 1328)<br>(SEQ ID NO: 3342)<br>(SEQ ID NO: 5356) |
| LDHA-409 Target: | 5'-GUAUCUUAAUGAAGGACUUGGCAga-3'<br>3'-GUCAUAGAAUUACUUCCUGAACCGUCU-5'<br>5'-CAGTATCTTAATGAAGGACTTGGCAGA-3' | (SEQ ID NO: 1329)<br>(SEQ ID NO: 3343)<br>(SEQ ID NO: 5357) |
| LDHA-410 Target: | 5'-UAUCUUAAUGAAGGACUUGGCAGat-3'<br>3'-UCAUAGAAUUACUUCCUGAACCGUCUA-5'<br>5'-AGTATCTTAATGAAGGACTTGGCAGAT-3' | (SEQ ID NO: 1330)<br>(SEQ ID NO: 3344)<br>(SEQ ID NO: 5358) |
| LDHA-411 Target: | 5'-AUCUUAAUGAAGGACUUGGCAGAtg-3'<br>3'-CAUAGAAUUACUUCCUGAACCGUCUAC-5'<br>5'-GTATCTTAATGAAGGACTTGGCAGATG-3' | (SEQ ID NO: 1331)<br>(SEQ ID NO: 3345)<br>(SEQ ID NO: 5359) |
| LDHA-412 Target: | 5'-UCUUAAUGAAGGACUUGGCAGAUga-3'<br>3'-AUAGAAUUACUUCCUGAACCGUCUACU-5'<br>5'-TATCTTAATGAAGGACTTGGCAGATGA-3' | (SEQ ID NO: 1332)<br>(SEQ ID NO: 3346)<br>(SEQ ID NO: 5360) |
| LDHA-413 Target: | 5'-CUUAAUGAAGGACUUGGCAGAUGaa-3'<br>3'-UAGAAUUACUUCCUGAACCGUCUACUU-5'<br>5'-ATCTTAATGAAGGACTTGGCAGATGAA-3' | (SEQ ID NO: 1333)<br>(SEQ ID NO: 3347)<br>(SEQ ID NO: 5361) |
| LDHA-414 Target: | 5'-UUAAUGAAGGACUUGGCAGAUGAac-3'<br>3'-AGAAUUACUUCCUGAACCGUCUACUUG-5'<br>5'-TCTTAATGAAGGACTTGGCAGATGAAC-3' | (SEQ ID NO: 1334)<br>(SEQ ID NO: 3348)<br>(SEQ ID NO: 5362) |
| LDHA-415 Target: | 5'-UAAUGAAGGACUUGGCAGAUGAAct-3'<br>3'-GAAUUACUUCCUGAACCGUCUACUUGA-5'<br>5'-CTTAATGAAGGACTTGGCAGATGAACT-3' | (SEQ ID NO: 1335)<br>(SEQ ID NO: 3349)<br>(SEQ ID NO: 5363) |
| LDHA-416 Target: | 5'-AAUGAAGGACUUGGCAGAUGAACtt-3'<br>3'-AAUUACUUCCUGAACCGUCUACUUGAA-5'<br>5'-TTAATGAAGGACTTGGCAGATGAACTT-3' | (SEQ ID NO: 1336)<br>(SEQ ID NO: 3350)<br>(SEQ ID NO: 5364) |
| LDHA-417 Target: | 5'-AUGAAGGACUUGGCAGAUGAACUtg-3'<br>3'-AUUACUUCCUGAACCGUCUACUUGAAC-5'<br>5'-TAATGAAGGACTTGGCAGATGAACTTG-3' | (SEQ ID NO: 1337)<br>(SEQ ID NO: 3351)<br>(SEQ ID NO: 5365) |
| LDHA-418 Target: | 5'-UGAAGGACUUGGCAGAUGAACUUgc-3'<br>3'-UUACUUCCUGAACCGUCUACUUGAACG-5'<br>5'-AATGAAGGACTTGGCAGATGAACTTGC-3' | (SEQ ID NO: 1338)<br>(SEQ ID NO: 3352)<br>(SEQ ID NO: 5366) |
| LDHA-419 Target: | 5'-GAAGGACUUGGCAGAUGAACUUGct-3'<br>3'-UACUUCCUGAACCGUCUACUUGAACGA-5'<br>5'-ATGAAGGACTTGGCAGATGAACTTGCT-3' | (SEQ ID NO: 1339)<br>(SEQ ID NO: 3353)<br>(SEQ ID NO: 5367) |
| LDHA-420 Target: | 5'-AAGGACUUGGCAGAUGAACUUGCtc-3'<br>3'-ACUUCCUGAACCGUCUACUUGAACGAG-5'<br>5'-TGAAGGACTTGGCAGATGAACTTGCTC-3' | (SEQ ID NO: 1340)<br>(SEQ ID NO: 3354)<br>(SEQ ID NO: 5368) |
| LDHA-421 Target: | 5'-AGGACUUGGCAGAUGAACUUGCUct-3'<br>3'-CUUCCUGAACCGUCUACUUGAACGAGA-5'<br>5'-GAAGGACTTGGCAGATGAACTTGCTCT-3' | (SEQ ID NO: 1341)<br>(SEQ ID NO: 3355)<br>(SEQ ID NO: 5369) |
| LDHA-422 Target: | 5'-GGACUUGGCAGAUGAACUUGCUCtt-3'<br>3'-UUCCUGAACCGUCUACUUGAACGAGAA-5'<br>5'-AAGGACTTGGCAGATGAACTTGCTCTT-3' | (SEQ ID NO: 1342)<br>(SEQ ID NO: 3356)<br>(SEQ ID NO: 5370) |
| LDHA-423 Target: | 5'-GACUUGGCAGAUGAACUUGCUCUtg-3'<br>3'-UCCUGAACCGUCUACUUGAACGAGAAC-5'<br>5'-AGGACTTGGCAGATGAACTTGCTCTTG-3' | (SEQ ID NO: 1343)<br>(SEQ ID NO: 3357)<br>(SEQ ID NO: 5371) |
| LDHA-424 Target: | 5'-ACUUGGCAGAUGAACUUGCUCUUgt-3'<br>3'-CCUGAACCGUCUACUUGAACGAGAACA-5'<br>5'-GGACTTGGCAGATGAACTTGCTCTTGT-3' | (SEQ ID NO: 1344)<br>(SEQ ID NO: 3358)<br>(SEQ ID NO: 5372) |
| LDHA-425 Target: | 5'-CUUGGCAGAUGAACUUGCUCUUGtt-3'<br>3'-CUGAACCGUCUACUUGAACGAGAACAA-5'<br>5'-GACTTGGCAGATGAACTTGCTCTTGTT-3' | (SEQ ID NO: 1345)<br>(SEQ ID NO: 3359)<br>(SEQ ID NO: 5373) |
| LDHA-426 Target: | 5'-UUGGCAGAUGAACUUGCUCUUGUtg-3'<br>3'-UGAACCGUCUACUUGAACGAGAACAAC-5'<br>5'-ACTTGGCAGATGAACTTGCTCTTGTTG-3' | (SEQ ID NO: 1346)<br>(SEQ ID NO: 3360)<br>(SEQ ID NO: 5374) |

TABLE 12-continued

Additional Selected Human Anti-Lactate Dehydrogenase DsiRNA Agents (Asymmetrics)

|  |  |  |
|---|---|---|
| LDHA-427 Target: | 5'-UGGCAGAUGAACUUGCUCUUGUUGa-3'<br>3'-GAACCGUCUACUUGAACGAGAACAACU-5'<br>5'-CTTGGCAGATGAACTTGCTCTTGTTGA-3' | (SEQ ID NO: 1347)<br>(SEQ ID NO: 3361)<br>(SEQ ID NO: 5375) |
| LDHA-428 Target: | 5'-GGCAGAUGAACUUGCUCUUGUUGat-3'<br>3'-AACCGUCUACUUGAACGAGAACAACUA-5'<br>5'-TTGGCAGATGAACTTGCTCTTGTTGAT-3' | (SEQ ID NO: 1348)<br>(SEQ ID NO: 3362)<br>(SEQ ID NO: 5376) |
| LDHA-429 Target: | 5'-GCAGAUGAACUUGCUCUUGUUGAtg-3'<br>3'-ACCGUCUACUUGAACGAGAACAACUAC-5'<br>5'-TGGCAGATGAACTTGCTCTTGTTGATG-3' | (SEQ ID NO: 1349)<br>(SEQ ID NO: 3363)<br>(SEQ ID NO: 5377) |
| LDHA-430 Target: | 5'-CAGAUGAACUUGCUCUUGUUGAUgt-3'<br>3'-CCGUCUACUUGAACGAGAACAACUACA-5'<br>5'-GGCAGATGAACTTGCTCTTGTTGATGT-3' | (SEQ ID NO: 1350)<br>(SEQ ID NO: 3364)<br>(SEQ ID NO: 5378) |
| LDHA-431 Target: | 5'-AGAUGAACUGCUCUUGUUGAUGtc-3'<br>3'-CGUCUACUUGAACGAGAACAACUACAG-5'<br>5'-GCAGATGAACTTGCTCTTGTTGATGTC-3' | (SEQ ID NO: 1351)<br>(SEQ ID NO: 3365)<br>(SEQ ID NO: 5379) |
| LDHA-432 Target: | 5'-GAUGAACUUGCUCUUGUUGAUGUca-3'<br>3'-GUCUACUUGAACGAGAACAACUACAGU-5'<br>5'-CAGATGAACTTGCTCTTGTTGATGTCA-3' | (SEQ ID NO: 1352)<br>(SEQ ID NO: 3366)<br>(SEQ ID NO: 5380) |
| LDHA-433 Target: | 5'-AUGAACUUGCUCUUGUUGAUGUCat-3'<br>3'-UCUACUUGAACGAGAACAACUACAGUA-5'<br>5'-AGATGAACTTGCTCTTGTTGATGTCAT-3' | (SEQ ID NO: 1353)<br>(SEQ ID NO: 3367)<br>(SEQ ID NO: 5381) |
| LDHA-434 Target: | 5'-UGAACUUGCUCUUGUUGAUGUCAtc-3'<br>3'-CUACUUGAACGAGAACAACUACAGUAG-5'<br>5'-GATGAACTTGCTCTTGTTGATGTCATC-3' | (SEQ ID NO: 1354)<br>(SEQ ID NO: 3368)<br>(SEQ ID NO: 5382) |
| LDHA-435 Target: | 5'-GAACUUGCUCUUGUUGAUGUCAUcg-3'<br>3'-UACUUGAACGAGAACAACUACAGUAGC-5'<br>5'-ATGAACTTGCTCTTGTTGATGTCATCG-3' | (SEQ ID NO: 1355)<br>(SEQ ID NO: 3369)<br>(SEQ ID NO: 5383) |
| LDHA-436 Target: | 5'-AACUUGCUCUUGUUGAUGUCAUCga-3'<br>3'-ACUUGAACGAGAACAACUACAGUAGCU-5'<br>5'-TGAACTTGCTCTTGTTGATGTCATCGA-3' | (SEQ ID NO: 1356)<br>(SEQ ID NO: 3370)<br>(SEQ ID NO: 5384) |
| LDHA-437 Target: | 5'-ACUUGCUCUUGUUGAUGUCAUCGaa-3'<br>3'-CUUGAACGAGAACAACUACAGUAGCUU-5'<br>5'-GAACTTGCTCTTGTTGATGTCATCGAA-3' | (SEQ ID NO: 1357)<br>(SEQ ID NO: 3371)<br>(SEQ ID NO: 5385) |
| LDHA-438 Target: | 5'-CUUGCUCUUGUUGAUGUCAUCGAag-3'<br>3'-UUGAACGAGAACAACUACAGUAGCUUC-5'<br>5'-AACTTGCTCTTGTTGATGTCATCGAAG-3' | (SEQ ID NO: 1358)<br>(SEQ ID NO: 3372)<br>(SEQ ID NO: 5386) |
| LDHA-439 Target: | 5'-UUGCUCUUGUUGAUGUCAUCGAAga-3'<br>3'-UGAACGAGAACAACUACAGUAGCUUCU-5'<br>5'-ACTTGCTCTTGTTGATGTCATCGAAGA-3' | (SEQ ID NO: 1359)<br>(SEQ ID NO: 3373)<br>(SEQ ID NO: 5387) |
| LDHA-440 Target: | 5'-UGCUCUUGUUGAUGUCAUCGAAGac-3'<br>3'-GAACGAGAACAACUACAGUAGCUUCUG-5'<br>5'-CTTGCTCTTGTTGATGTCATCGAAGAC-3' | (SEQ ID NO: 1360)<br>(SEQ ID NO: 3374)<br>(SEQ ID NO: 5388) |
| LDHA-441 Target: | 5'-GCUCUUGUUGAUGUCAUCGAAGAca-3'<br>3'-AACGAGAACAACUACAGUAGCUUCUGU-5'<br>5'-TTGCTCTTGTTGATGTCATCGAAGACA-3' | (SEQ ID NO: 1361)<br>(SEQ ID NO: 3375)<br>(SEQ ID NO: 5389) |
| LDHA-442 Target: | 5'-CUCUUGUUGAUGUCAUCGAAGACaa-3'<br>3'-ACGAGAACAACUACAGUAGCUUCUGUU-5'<br>5'-TGCTCTTGTTGATGTCATCGAAGACAA-3' | (SEQ ID NO: 1362)<br>(SEQ ID NO: 3376)<br>(SEQ ID NO: 5390) |
| LDHA-443 Target: | 5'-UCUUGUUGAUGUCAUCGAAGACAaa-3'<br>3'-CGAGAACAACUACAGUAGCUUCUGUUU-5'<br>5'-GCTCTTGTTGATGTCATCGAAGACAAA-3' | (SEQ ID NO: 1363)<br>(SEQ ID NO: 3377)<br>(SEQ ID NO: 5391) |
| LDHA-444 Target: | 5'-CUUGUUGAUGUCAUCGAAGACAAat-3'<br>3'-GAGAACAACUACAGUAGCUUCUGUUUA-5'<br>5'-CTCTTGTTGATGTCATCGAAGACAAAT-3' | (SEQ ID NO: 1364)<br>(SEQ ID NO: 3378)<br>(SEQ ID NO: 5392) |
| LDHA-445 Target: | 5'-UUGUUGAUGUCAUCGAAGACAAAtt-3'<br>3'-AGAACAACUACAGUAGCUUCUGUUUAA-5'<br>5'-TCTTGTTGATGTCATCGAAGACAAATT-3' | (SEQ ID NO: 1365)<br>(SEQ ID NO: 3379)<br>(SEQ ID NO: 5393) |

TABLE 12-continued

Additional Selected Human Anti-Lactate Dehydrogenase DsiRNA Agents (Asymmetrics)

| | | |
|---|---|---|
| LDHA-446 Target: | 5'-UGUUGAUGUCAUCGAAGACAAAUtg-3'<br>3'-GAACAACUACAGUAGCUUCUGUUUAAC-5'<br>5'-CTTGTTGATGTCATCGAAGACAAATTG-3' | (SEQ ID NO: 1366)<br>(SEQ ID NO: 3380)<br>(SEQ ID NO: 5394) |
| LDHA-447 Target: | 5'-GUUGAUGUCAUCGAAGACAAAUUga-3'<br>3'-AACAACUACAGUAGCUUCUGUUUAACU-5'<br>5'-TTGTTGATGTCATCGAAGACAAATTGA-3' | (SEQ ID NO: 1367)<br>(SEQ ID NO: 3381)<br>(SEQ ID NO: 5395) |
| LDHA-448 Target: | 5'-UUGAUGUCAUCGAAGACAAAUUGaa-3'<br>3'-ACAACUACAGUAGCUUCUGUUUAACUU-5'<br>5'-TGTTGATGTCATCGAAGACAAATTGAA-3' | (SEQ ID NO: 1368)<br>(SEQ ID NO: 3382)<br>(SEQ ID NO: 5396) |
| LDHA-449 Target: | 5'-UGAUGUCAUCGAAGACAAAUUGAag-3'<br>3'-CAACUACAGUAGCUUCUGUUUAACUUC-5'<br>5'-GTTGATGTCATCGAAGACAAATTGAAG-3' | (SEQ ID NO: 1369)<br>(SEQ ID NO: 3383)<br>(SEQ ID NO: 5397) |
| LDHA-450 Target: | 5'-GAUGUCAUCGAAGACAAAUUGAAgg-3'<br>3'-AACUACAGUAGCUUCUGUUUAACUUCC-5'<br>5'-TTGATGTCATCGAAGACAAATTGAAGG-3' | (SEQ ID NO: 1370)<br>(SEQ ID NO: 3384)<br>(SEQ ID NO: 5398) |
| LDHA-451 Target: | 5'-AUGUCAUCGAAGACAAAUUGAAGgg-3'<br>3'-ACUACAGUAGCUUCUGUUUAACUUCCC-5'<br>5'-TGATGTCATCGAAGACAAATTGAAGGG-3' | (SEQ ID NO: 1371)<br>(SEQ ID NO: 3385)<br>(SEQ ID NO: 5399) |
| LDHA-452 Target: | 5'-UGUCAUCGAAGACAAAUUGAAGGga-3'<br>3'-CUACAGUAGCUUCUGUUUAACUUCCCU-5'<br>5'-GATGTCATCGAAGACAAATTGAAGGGA-3' | (SEQ ID NO: 1372)<br>(SEQ ID NO: 3386)<br>(SEQ ID NO: 5400) |
| LDHA-453 Target: | 5'-GUCAUCGAAGACAAAUUGAAGGGag-3'<br>3'-UACAGUAGCUUCUGUUUAACUUCCCUC-5'<br>5'-ATGTCATCGAAGACAAATTGAAGGGAG-3' | (SEQ ID NO: 1373)<br>(SEQ ID NO: 3387)<br>(SEQ ID NO: 5401) |
| LDHA-454 Target: | 5'-UCAUCGAAGACAAAUUGAAGGGAga-3'<br>3'-ACAGUAGCUUCUGUUUAACUUCCCUCU-5'<br>5'-TGTCATCGAAGACAAATTGAAGGGAGA-3' | (SEQ ID NO: 1374)<br>(SEQ ID NO: 3388)<br>(SEQ ID NO: 5402) |
| LDHA-455 Target: | 5'-CAUCGAAGACAAAUUGAAGGGAGag-3'<br>3'-CAGUAGCUUCUGUUUAACUUCCCUCUC-5'<br>5'-GTCATCGAAGACAAATTGAAGGGAGAG-3' | (SEQ ID NO: 1375)<br>(SEQ ID NO: 3389)<br>(SEQ ID NO: 5403) |
| LDHA-456 Target: | 5'-AUCGAAGACAAAUUGAAGGGAGAga-3'<br>3'-AGUAGCUUCUGUUUAACUUCCCUCUCU-5'<br>5'-TCATCGAAGACAAATTGAAGGGAGAGA-3' | (SEQ ID NO: 1376)<br>(SEQ ID NO: 3390)<br>(SEQ ID NO: 5404) |
| LDHA-457 Target: | 5'-UCGAAGACAAAUUGAAGGGAGAGat-3'<br>3'-GUAGCUUCUGUUUAACUUCCCUCUCUA-5'<br>5'-CATCGAAGACAAATTGAAGGGAGAGAT-3' | (SEQ ID NO: 1377)<br>(SEQ ID NO: 3391)<br>(SEQ ID NO: 5405) |
| LDHA-458 Target: | 5'-CGAAGACAAAUUGAAGGGAGAGAtg-3'<br>3'-UAGCUUCUGUUUAACUUCCCUCUCUAC-5'<br>5'-ATCGAAGACAAATTGAAGGGAGAGATG-3' | (SEQ ID NO: 1378)<br>(SEQ ID NO: 3392)<br>(SEQ ID NO: 5406) |
| LDHA-459 Target: | 5'-GAAGACAAAUUGAAGGGAGAGAUga-3'<br>3'-AGCUUCUGUUUAACUUCCCUCUCUACU-5'<br>5'-TCGAAGACAAATTGAAGGGAGAGATGA-3' | (SEQ ID NO: 1379)<br>(SEQ ID NO: 3393)<br>(SEQ ID NO: 5407) |
| LDHA-460 Target: | 5'-AAGACAAAUUGAAGGGAGAGAUGat-3'<br>3'-GCUUCUGUUUAACUUCCCUCUCUACUA-5'<br>5'-CGAAGACAAATTGAAGGGAGAGATGAT-3' | (SEQ ID NO: 1380)<br>(SEQ ID NO: 3394)<br>(SEQ ID NO: 5408) |
| LDHA-461 Target: | 5'-AGACAAAUUGAAGGGAGAGAUGAtg-3'<br>3'-CUUCUGUUUAACUUCCCUCUCUACUAC-5'<br>5'-GAAGACAAATTGAAGGGAGAGATGATG-3' | (SEQ ID NO: 1381)<br>(SEQ ID NO: 3395)<br>(SEQ ID NO: 5409) |
| LDHA-462 Target: | 5'-GACAAAUUGAAGGGAGAGAUGAUgg-3'<br>3'-UUCUGUUUAACUUCCCUCUCUACUACC-5'<br>5'-AAGACAAATTGAAGGGAGAGATGATGG-3' | (SEQ ID NO: 1382)<br>(SEQ ID NO: 3396)<br>(SEQ ID NO: 5410) |
| LDHA-463 Target: | 5'-ACAAAUUGAAGGGAGAGAUGAUGga-3'<br>3'-UCUGUUUAACUUCCCUCUCUACUACCU-5'<br>5'-AGACAAATTGAAGGGAGAGATGATGGA-3' | (SEQ ID NO: 1383)<br>(SEQ ID NO: 3397)<br>(SEQ ID NO: 5411) |
| LDHA-464 Target: | 5'-CAAAUUGAAGGGAGAGAUGAUGGat-3'<br>3'-CUGUUUAACUUCCCUCUCUACUACCUA-5'<br>5'-GACAAATTGAAGGGAGAGATGATGGAT-3' | (SEQ ID NO: 1384)<br>(SEQ ID NO: 3398)<br>(SEQ ID NO: 5412) |

TABLE 12-continued

Additional Selected Human Anti-Lactate Dehydrogenase DsiRNA Agents (Asymmetrics)

|  |  |  |
|---|---|---|
| LDHA-465 Target: | 5'-AAAUUGAAGGGAGAGAUGAUGGAtc-3'<br>3'-UGUUUAACUUCCCUCUCUACUACCUAG-5'<br>5'-ACAAATTGAAGGGAGAGATGATGGATC-3' | (SEQ ID NO: 1385)<br>(SEQ ID NO: 3399)<br>(SEQ ID NO: 5413) |
| LDHA-466 Target: | 5'-AAUUGAAGGGAGAGAUGAUGGAUct-3'<br>3'-GUUUAACUUCCCUCUCUACUACCUAGA-5'<br>5'-CAAATTGAAGGGAGAGATGATGGATCT-3' | (SEQ ID NO: 1386)<br>(SEQ ID NO: 3400)<br>(SEQ ID NO: 5414) |
| LDHA-467 Target: | 5'-AUUGAAGGGAGAGAUGAUGGAUCtc-3'<br>3'-UUUAACUUCCCUCUCUACUACCUAGAG-5'<br>5'-AAATTGAAGGGAGAGATGATGGATCTC-3' | (SEQ ID NO: 1387)<br>(SEQ ID NO: 3401)<br>(SEQ ID NO: 5415) |
| LDHA-468 Target: | 5'-UUGAAGGGAGAGAUGAUGGAUCUcc-3'<br>3'-UUAACUUCCCUCUCUACUACCUAGAGG-5'<br>5'-AATTGAAGGGAGAGATGATGGATCTCC-3' | (SEQ ID NO: 1388)<br>(SEQ ID NO: 3402)<br>(SEQ ID NO: 5416) |
| LDHA-469 Target: | 5'-UGAAGGGAGAGAUGAUGGAUCUCca-3'<br>3'-UAACUUCCCUCUCUACUACCUAGAGGU-5'<br>5'-ATTGAAGGGAGAGATGATGGATCTCCA-3' | (SEQ ID NO: 1389)<br>(SEQ ID NO: 3403)<br>(SEQ ID NO: 5417) |
| LDHA-470 Target: | 5'-GAAGGGAGAGAUGAUGGAUCUCCaa-3'<br>3'-AACUUCCCUCUCUACUACCUAGAGGUU-5'<br>5'-TTGAAGGGAGAGATGATGGATCTCCAA-3' | (SEQ ID NO: 1390)<br>(SEQ ID NO: 3404)<br>(SEQ ID NO: 5418) |
| LDHA-471 Target: | 5'-AAGGGAGAGAUGAUGGAUCUCCAac-3'<br>3'-ACUUCCCUCUCUACUACCUAGAGGUUG-5'<br>5'-TGAAGGGAGAGATGATGGATCTCCAAC-3' | (SEQ ID NO: 1391)<br>(SEQ ID NO: 3405)<br>(SEQ ID NO: 5419) |
| LDHA-472 Target: | 5'-AGGGAGAGAUGAUGGAUCUCCAAca-3'<br>3'-CUUCCCUCUCUACUACCUAGAGGUUGU-5'<br>5'-GAAGGGAGAGATGATGGATCTCCAACA-3' | (SEQ ID NO: 1392)<br>(SEQ ID NO: 3406)<br>(SEQ ID NO: 5420) |
| LDHA-473 Target: | 5'-GGGAGAGAUGAUGGAUCUCCAACat-3'<br>3'-UUCCCUCUCUACUACCUAGAGGUUGUA-5'<br>5'-AAGGGAGAGATGATGGATCTCCAACAT-3' | (SEQ ID NO: 1393)<br>(SEQ ID NO: 3407)<br>(SEQ ID NO: 5421) |
| LDHA-474 Target: | 5'-GGAGAGAUGAUGGAUCUCCAACAtg-3'<br>3'-UCCCUCUCUACUACCUAGAGGUUGUAC-5'<br>5'-AGGGAGAGATGATGGATCTCCAACATG-3' | (SEQ ID NO: 1394)<br>(SEQ ID NO: 3408)<br>(SEQ ID NO: 5422) |
| LDHA-475 Target: | 5'-GAGAGAUGAUGGAUCUCCAACAUgg-3'<br>3'-CCCUCUCUACUACCUAGAGGUUGUACC-5'<br>5'-GGGAGAGATGATGGATCTCCAACATGG-3' | (SEQ ID NO: 1395)<br>(SEQ ID NO: 3409)<br>(SEQ ID NO: 5423) |
| LDHA-476 Target: | 5'-AGAGAUGAUGGAUCUCCAACAUGgc-3'<br>3'-CCUCUCUACUACCUAGAGGUUGUACCG-5'<br>5'-GGAGAGATGATGGATCTCCAACATGGC-3' | (SEQ ID NO: 1396)<br>(SEQ ID NO: 3410)<br>(SEQ ID NO: 5424) |
| LDHA-477 Target: | 5'-GAGAUGAUGGAUCUCCAACAUGGca-3'<br>3'-CUCUCUACUACCUAGAGGUUGUACCGU-5'<br>5'-GAGAGATGATGGATCTCCAACATGGCA-3' | (SEQ ID NO: 1397)<br>(SEQ ID NO: 3411)<br>(SEQ ID NO: 5425) |
| LDHA-478 Target: | 5'-AGAUGAUGGAUCUCCAACAUGGCag-3'<br>3'-UCUCUACUACCUAGAGGUUGUACCGUC-5'<br>5'-AGAGATGATGGATCTCCAACATGGCAG-3' | (SEQ ID NO: 1398)<br>(SEQ ID NO: 3412)<br>(SEQ ID NO: 5426) |
| LDHA-479 Target: | 5'-GAUGAUGGAUCUCCAACAUGGCAgc-3'<br>3'-CUCUACUACCUAGAGGUUGUACCGUCG-5'<br>5'-GAGATGATGGATCTCCAACATGGCAGC-3' | (SEQ ID NO: 1399)<br>(SEQ ID NO: 3413)<br>(SEQ ID NO: 5427) |
| LDHA-480 Target: | 5'-AUGAUGGAUCUCCAACAUGGCAGcc-3'<br>3'-UCUACUACCUAGAGGUUGUACCGUCGG-5'<br>5'-AGATGATGGATCTCCAACATGGCAGCC-3' | (SEQ ID NO: 1400)<br>(SEQ ID NO: 3414)<br>(SEQ ID NO: 5428) |
| LDHA-481 Target: | 5'-UGAUGGAUCUCCAACAUGGCAGCct-3'<br>3'-CUACUACCUAGAGGUUGUACCGUCGGA-5'<br>5'-GATGATGGATCTCCAACATGGCAGCCT-3' | (SEQ ID NO: 1401)<br>(SEQ ID NO: 3415)<br>(SEQ ID NO: 5429) |
| LDHA-482 Target: | 5'-GAUGGAUCUCCAACAUGGCAGCCtt-3'<br>3'-UACUACCUAGAGGUUGUACCGUCGGAA-5'<br>5'-ATGATGGATCTCCAACATGGCAGCCTT-3' | (SEQ ID NO: 1402)<br>(SEQ ID NO: 3416)<br>(SEQ ID NO: 5430) |
| LDHA-483 Target: | 5'-AUGGAUCUCCAACAUGGCAGCCUtt-3'<br>3'-ACUACCUAGAGGUUGUACCGUCGGAAA-5'<br>5'-TGATGGATCTCCAACATGGCAGCCTTT-3' | (SEQ ID NO: 1403)<br>(SEQ ID NO: 3417)<br>(SEQ ID NO: 5431) |

TABLE 12-continued

Additional Selected Human Anti-Lactate Dehydrogenase DsiRNA Agents (Asymmetrics)

|  |  |  |
|---|---|---|
| LDHA-484 Target: | 5'-UGGAUCUCCAACAUGGCAGCCUUtt-3'<br>3'-CUACCUAGAGGUUGUACCGUCGGAAAA-5'<br>5'-GATGGATCTCCAACATGGCAGCCTTTT-3' | (SEQ ID NO: 1404)<br>(SEQ ID NO: 3418)<br>(SEQ ID NO: 5432) |
| LDHA-485 Target: | 5'-GGAUCUCCAACAUGGCAGCCUUUtc-3'<br>3'-UACCUAGAGGUUGUACCGUCGGAAAAG-5'<br>5'-ATGGATCTCCAACATGGCAGCCTTTTC-3' | (SEQ ID NO: 1405)<br>(SEQ ID NO: 3419)<br>(SEQ ID NO: 5433) |
| LDHA-486 Target: | 5'-GAUCUCCAACAUGGCAGCCUUUUcc-3'<br>3'-ACCUAGAGGUUGUACCGUCGGAAAAGG-5'<br>5'-TGGATCTCCAACATGGCAGCCTTTTCC-3' | (SEQ ID NO: 1406)<br>(SEQ ID NO: 3420)<br>(SEQ ID NO: 5434) |
| LDHA-487 Target: | 5'-AUCUCCAACAUGGCAGCCUUUUCct-3'<br>3'-CCUAGAGGUUGUACCGUCGGAAAAGGA-5'<br>5'-GGATCTCCAACATGGCAGCCTTTTCCT-3' | (SEQ ID NO: 1407)<br>(SEQ ID NO: 3421)<br>(SEQ ID NO: 5435) |
| LDHA-488 Target: | 5'-UCUCCAACAUGGCAGCCUUUUCCtt-3'<br>3'-CUAGAGGUUGUACCGUCGGAAAAGGAA-5'<br>5'-GATCTCCAACATGGCAGCCTTTTCCTT-3' | (SEQ ID NO: 1408)<br>(SEQ ID NO: 3422)<br>(SEQ ID NO: 5436) |
| LDHA-489 Target: | 5'-CUCCAACAUGGCAGCCUUUUCCUta-3'<br>3'-UAGAGGUUGUACCGUCGGAAAAGGAAU-5'<br>5'-ATCTCCAACATGGCAGCCTTTTCCTTA-3' | (SEQ ID NO: 1409)<br>(SEQ ID NO: 3423)<br>(SEQ ID NO: 5437) |
| LDHA-490 Target: | 5'-UCCAACAUGGCAGCCUUUUCCUUag-3'<br>3'-AGAGGUUGUACCGUCGGAAAAGGAAUC-5'<br>5'-TCTCCAACATGGCAGCCTTTTCCTTAG-3' | (SEQ ID NO: 1410)<br>(SEQ ID NO: 3424)<br>(SEQ ID NO: 5438) |
| LDHA-491 Target: | 5'-CCAACAUGGCAGCCUUUUCCUUAga-3'<br>3'-GAGGUUGUACCGUCGGAAAAGGAAUCU-5'<br>5'-CTCCAACATGGCAGCCTTTTCCTTAGA-3' | (SEQ ID NO: 1411)<br>(SEQ ID NO: 3425)<br>(SEQ ID NO: 5439) |
| LDHA-492 Target: | 5'-CAACAUGGCAGCCUUUUCCUUAGaa-3'<br>3'-AGGUUGUACCGUCGGAAAAGGAAUCUU-5'<br>5'-TCCAACATGGCAGCCTTTTCCTTAGAA-3' | (SEQ ID NO: 1412)<br>(SEQ ID NO: 3426)<br>(SEQ ID NO: 5440) |
| LDHA-493 Target: | 5'-AACAUGGCAGCCUUUUCCUUAGAac-3'<br>3'-GGUUGUACCGUCGGAAAAGGAAUCUUG-5'<br>5'-CCAACATGGCAGCCTTTTCCTTAGAAC-3' | (SEQ ID NO: 1413)<br>(SEQ ID NO: 3427)<br>(SEQ ID NO: 5441) |
| LDHA-494 Target: | 5'-ACAUGGCAGCCUUUUCCUUAGAAca-3'<br>3'-GUUGUACCGUCGGAAAAGGAAUCUUGU-5'<br>5'-CAACATGGCAGCCTTTTCCTTAGAACA-3' | (SEQ ID NO: 1414)<br>(SEQ ID NO: 3428)<br>(SEQ ID NO: 5442) |
| LDHA-495 Target: | 5'-CAUGGCAGCCUUUUCCUUAGAACac-3'<br>3'-UUGUACCGUCGGAAAAGGAAUCUUGUG-5'<br>5'-AACATGGCAGCCTTTTCCTTAGAACAC-3' | (SEQ ID NO: 1415)<br>(SEQ ID NO: 3429)<br>(SEQ ID NO: 5443) |
| LDHA-496 Target: | 5'-AUGGCAGCCUUUUCCUUAGAACAcc-3'<br>3'-UGUACCGUCGGAAAAGGAAUCUUGUGG-5'<br>5'-ACATGGCAGCCTTTTCCTTAGAACACC-3' | (SEQ ID NO: 1416)<br>(SEQ ID NO: 3430)<br>(SEQ ID NO: 5444) |
| LDHA-497 Target: | 5'-UGGCAGCCUUUUCCUUAGAACACca-3'<br>3'-GUACCGUCGGAAAAGGAAUCUUGUGGU-5'<br>5'-CATGGCAGCCTTTTCCTTAGAACACCA-3' | (SEQ ID NO: 1417)<br>(SEQ ID NO: 3431)<br>(SEQ ID NO: 5445) |
| LDHA-498 Target: | 5'-GGCAGCCUUUUCCUUAGAACACCaa-3'<br>3'-UACCGUCGGAAAAGGAAUCUUGUGGUU-5'<br>5'-ATGGCAGCCTTTTCCTTAGAACACCAA-3' | (SEQ ID NO: 1418)<br>(SEQ ID NO: 3432)<br>(SEQ ID NO: 5446) |
| LDHA-499 Target: | 5'-GCAGCCUUUUCCUUAGAACACCAaa-3'<br>3'-ACCGUCGGAAAAGGAAUCUUGUGGUUU-5'<br>5'-TGGCAGCCTTTTCCTTAGAACACCAAA-3' | (SEQ ID NO: 1419)<br>(SEQ ID NO: 3433)<br>(SEQ ID NO: 5447) |
| LDHA-500 Target: | 5'-CAGCCUUUUCCUUAGAACACCAAag-3'<br>3'-CCGUCGGAAAAGGAAUCUUGUGGUUUC-5'<br>5'-GGCAGCCTTTTCCTTAGAACACCAAAG-3' | (SEQ ID NO: 1420)<br>(SEQ ID NO: 3434)<br>(SEQ ID NO: 5448) |
| LDHA-501 Target: | 5'-AGCCUUUUCCUUAGAACACCAAAga-3'<br>3'-CGUCGGAAAAGGAAUCUUGUGGUUUCU-5'<br>5'-GCAGCCTTTTCCTTAGAACACCAAAGA-3' | (SEQ ID NO: 1421)<br>(SEQ ID NO: 3435)<br>(SEQ ID NO: 5449) |
| LDHA-502 Target: | 5'-GCCUUUUCCUUAGAACACCAAAGat-3'<br>3'-GUCGGAAAAGGAAUCUUGUGGUUUCUA-5'<br>5'-CAGCCTTTTCCTTAGAACACCAAAGAT-3' | (SEQ ID NO: 1422)<br>(SEQ ID NO: 3436)<br>(SEQ ID NO: 5450) |

TABLE 12-continued

Additional Selected Human Anti-Lactate Dehydrogenase DsiRNA Agents (Asymmetrics)

|  |  |  |
|---|---|---|
| LDHA-503 Target: | 5'-CCUUUCCUUAGAACACCAAAGAtt-3'<br>3'-UCGGAAAAGGAAUCUUGUGGUUUCUAA-5'<br>5'-AGCCTTTTCCTTAGAACACCAAAGATT-3' | (SEQ ID NO: 1423)<br>(SEQ ID NO: 3437)<br>(SEQ ID NO: 5451) |
| LDHA-504 Target: | 5'-CUUUCCUUAGAACACCAAAGAUtg-3'<br>3'-CGGAAAAGGAAUCUUGUGGUUUCUAAC-5'<br>5'-GCCTTTTCCTTAGAACACCAAAGATTG-3' | (SEQ ID NO: 1424)<br>(SEQ ID NO: 3438)<br>(SEQ ID NO: 5452) |
| LDHA-505 Target: | 5'-UUUCCUUAGAACACCAAAGAUUgt-3'<br>3'-GGAAAAGGAAUCUUGUGGUUUCUAACA-5'<br>5'-CCTTTTCCTTAGAACACCAAAGATTGT-3' | (SEQ ID NO: 1425)<br>(SEQ ID NO: 3439)<br>(SEQ ID NO: 5453) |
| LDHA-506 Target: | 5'-UUUCCUUAGAACACCAAAGAUUGtc-3'<br>3'-GAAAAGGAAUCUUGUGGUUUCUAACAG-5'<br>5'-CTTTTCCTTAGAACACCAAAGATTGTC-3' | (SEQ ID NO: 1426)<br>(SEQ ID NO: 3440)<br>(SEQ ID NO: 5454) |
| LDHA-507 Target: | 5'-UUCCUUAGAACACCAAAGAUUGUct-3'<br>3'-AAAAGGAAUCUUGUGGUUUCUAACAGA-5'<br>5'-TTTTCCTTAGAACACCAAAGATTGTCT-3' | (SEQ ID NO: 1427)<br>(SEQ ID NO: 3441)<br>(SEQ ID NO: 5455) |
| LDHA-508 Target: | 5'-UCCUUAGAACACCAAAGAUUGUCtc-3'<br>3'-AAAGGAAUCUUGUGGUUUCUAACAGAG-5'<br>5'-TTTCCTTAGAACACCAAAGATTGTCTC-3' | (SEQ ID NO: 1428)<br>(SEQ ID NO: 3442)<br>(SEQ ID NO: 5456) |
| LDHA-509 Target: | 5'-CCUUAGAACACCAAAGAUUGUCUct-3'<br>3'-AAGGAAUCUUGUGGUUUCUAACAGAGA-5'<br>5'-TTCCTTAGAACACCAAAGATTGTCTCT-3' | (SEQ ID NO: 1429)<br>(SEQ ID NO: 3443)<br>(SEQ ID NO: 5457) |
| LDHA-510 Target: | 5'-CUUAGAACACCAAAGAUUGUCUCtg-3'<br>3'-AGGAAUCUUGUGGUUUCUAACAGAGAC-5'<br>5'-TCCTTAGAACACCAAAGATTGTCTCTG-3' | (SEQ ID NO: 1430)<br>(SEQ ID NO: 3444)<br>(SEQ ID NO: 5458) |
| LDHA-511 Target: | 5'-UUAGAACACCAAAGAUUGUCUCUgg-3'<br>3'-GGAAUCUUGUGGUUUCUAACAGAGACC-5'<br>5'-CCTTAGAACACCAAAGATTGTCTCTGG-3' | (SEQ ID NO: 1431)<br>(SEQ ID NO: 3445)<br>(SEQ ID NO: 5459) |
| LDHA-512 Target: | 5'-UAGAACACCAAAGAUUGUCUCUGgc-3'<br>3'-GAAUCUUGUGGUUUCUAACAGAGACCG-5'<br>5'-CTTAGAACACCAAAGATTGTCTCTGGC-3' | (SEQ ID NO: 1432)<br>(SEQ ID NO: 3446)<br>(SEQ ID NO: 5460) |
| LDHA-513 Target: | 5'-AGAACACCAAAGAUUGUCUCUGGca-3'<br>3'-AAUCUUGUGGUUUCUAACAGAGACCGU-5'<br>5'-TTAGAACACCAAAGATTGTCTCTGGCA-3' | (SEQ ID NO: 1433)<br>(SEQ ID NO: 3447)<br>(SEQ ID NO: 5461) |
| LDHA-514 Target: | 5'-GAACACCAAAGAUUGUCUCUGGCaa-3'<br>3'-AUCUUGUGGUUUCUAACAGAGACCGUU-5'<br>5'-TAGAACACCAAAGATTGTCTCTGGCAA-3' | (SEQ ID NO: 1434)<br>(SEQ ID NO: 3448)<br>(SEQ ID NO: 5462) |
| LDHA-515 Target: | 5'-AACACCAAAGAUUGUCUCUGGCAaa-3'<br>3'-UCUUGUGGUUUCUAACAGAGACCGUUU-5'<br>5'-AGAACACCAAAGATTGTCTCTGGCAAA-3' | (SEQ ID NO: 1435)<br>(SEQ ID NO: 3449)<br>(SEQ ID NO: 5463) |
| LDHA-516 Target: | 5'-ACACCAAAGAUUGUCUCUGGCAAag-3'<br>3'-CUUGUGGUUUCUAACAGAGACCGUUUC-5'<br>5'-GAACACCAAAGATTGTCTCTGGCAAAG-3' | (SEQ ID NO: 1436)<br>(SEQ ID NO: 3450)<br>(SEQ ID NO: 5464) |
| LDHA-517 Target: | 5'-CACCAAAGAUUGUCUCUGGCAAAga-3'<br>3'-UUGUGGUUUCUAACAGAGACCGUUUCU-5'<br>5'-AACACCAAAGATTGTCTCTGGCAAAGA-3' | (SEQ ID NO: 1437)<br>(SEQ ID NO: 3451)<br>(SEQ ID NO: 5465) |
| LDHA-518 Target: | 5'-ACCAAAGAUUGUCUCUGGCAAAGac-3'<br>3'-UGUGGUUUCUAACAGAGACCGUUUCUG-5'<br>5'-ACACCAAAGATTGTCTCTGGCAAAGAC-3' | (SEQ ID NO: 1438)<br>(SEQ ID NO: 3452)<br>(SEQ ID NO: 5466) |
| LDHA-519 Target: | 5'-CCAAAGAUUGUCUCUGGCAAAGAct-3'<br>3'-GUGGUUUCUAACAGAGACCGUUUCUGA-5'<br>5'-CACCAAAGATTGTCTCTGGCAAAGACT-3' | (SEQ ID NO: 1439)<br>(SEQ ID NO: 3453)<br>(SEQ ID NO: 5467) |
| LDHA-520 Target: | 5'-CAAAGAUUGUCUCUGGCAAAGACta-3'<br>3'-UGGUUUCUAACAGAGACCGUUUCUGAU-5'<br>5'-ACCAAAGATTGTCTCTGGCAAAGACTA-3' | (SEQ ID NO: 1440)<br>(SEQ ID NO: 3454)<br>(SEQ ID NO: 5468) |
| LDHA-521 Target: | 5'-AAAGAUUGUCUCUGGCAAAGACUat-3'<br>3'-GGUUUCUAACAGAGACCGUUUCUGAUA-5'<br>5'-CCAAAGATTGTCTCTGGCAAAGACTAT-3' | (SEQ ID NO: 1441)<br>(SEQ ID NO: 3455)<br>(SEQ ID NO: 5469) |

TABLE 12-continued

Additional Selected Human Anti-Lactate Dehydrogenase DsiRNA Agents (Asymmetrics)

| | | |
|---|---|---|
| LDHA-522 | 5'-AAGAUUGUCUCUGGCAAAGACUAta-3'<br>3'-GUUUCUAACAGAGACCGUUUCUGAUAUAU-5'<br>Target: 5'-CAAAGATTGTCTCTGGCAAAGACTATA-3' | (SEQ ID NO: 1442)<br>(SEQ ID NO: 3456)<br>(SEQ ID NO: 5470) |
| LDHA-523 | 5'-AGAUUGUCUCUGGCAAAGACUAUaa-3'<br>3'-UUUCUAACAGAGACCGUUUCUGAUAUU-5'<br>Target: 5'-AAAGATTGTCTCTGGCAAAGACTATAA-3' | (SEQ ID NO: 1443)<br>(SEQ ID NO: 3457)<br>(SEQ ID NO: 5471) |
| LDHA-524 | 5'-GAUUGUCUCUGGCAAAGACUAUAat-3'<br>3'-UUCUAACAGAGACCGUUUCUGAUAUUA-5'<br>Target: 5'-AAGATTGTCTCTGGCAAAGACTATAAT-3' | (SEQ ID NO: 1444)<br>(SEQ ID NO: 3458)<br>(SEQ ID NO: 5472) |
| LDHA-525 | 5'-AUUGUCUCUGGCAAAGACUAUAAtg-3'<br>3'-UCUAACAGAGACCGUUUCUGAUAUUAC-5'<br>Target: 5'-AGATTGTCTCTGGCAAAGACTATAATG-3' | (SEQ ID NO: 1445)<br>(SEQ ID NO: 3459)<br>(SEQ ID NO: 5473) |
| LDHA-526 | 5'-UUGUCUCUGGCAAAGACUAUAAUgt-3'<br>3'-CUAACAGAGACCGUUUCUGAUAUUACA-5'<br>Target: 5'-GATTGTCTCTGGCAAAGACTATAATGT-3' | (SEQ ID NO: 1446)<br>(SEQ ID NO: 3460)<br>(SEQ ID NO: 5474) |
| LDHA-527 | 5'-UGUCUCUGGCAAAGACUAUAAUGta-3'<br>3'-UAACAGAGACCGUUUCUGAUAUUACAU-5'<br>Target: 5'-ATTGTCTCTGGCAAAGACTATAATGTA-3' | (SEQ ID NO: 1447)<br>(SEQ ID NO: 3461)<br>(SEQ ID NO: 5475) |
| LDHA-528 | 5'-GUCUCUGGCAAAGACUAUAAUGUaa-3'<br>3'-AACAGAGACCGUUUCUGAUAUUACAUU-5'<br>Target: 5'-TTGTCTCTGGCAAAGACTATAATGTAA-3' | (SEQ ID NO: 1448)<br>(SEQ ID NO: 3462)<br>(SEQ ID NO: 5476) |
| LDHA-529 | 5'-UCUCUGGCAAAGACUAUAAUGUAac-3'<br>3'-ACAGAGACCGUUUCUGAUAUUACAUUG-5'<br>Target: 5'-TGTCTCTGGCAAAGACTATAATGTAAC-3' | (SEQ ID NO: 1449)<br>(SEQ ID NO: 3463)<br>(SEQ ID NO: 5477) |
| LDHA-530 | 5'-CUCUGGCAAAGACUAUAAUGUAAct-3'<br>3'-CAGAGACCGUUUCUGAUAUUACAUUGA-5'<br>Target: 5'-GTCTCTGGCAAAGACTATAATGTAACT-3' | (SEQ ID NO: 1450)<br>(SEQ ID NO: 3464)<br>(SEQ ID NO: 5478) |
| LDHA-531 | 5'-UCUGGCAAAGACUAUAAUGUAACtg-3'<br>3'-AGAGACCGUUUCUGAUAUUACAUUGAC-5'<br>Target: 5'-TCTCTGGCAAAGACTATAATGTAACTG-3' | (SEQ ID NO: 1451)<br>(SEQ ID NO: 3465)<br>(SEQ ID NO: 5479) |
| LDHA-532 | 5'-CUGGCAAAGACUAUAAUGUAACUgc-3'<br>3'-GAGACCGUUUCUGAUAUUACAUUGACG-5'<br>Target: 5'-CTCTGGCAAAGACTATAATGTAACTGC-3' | (SEQ ID NO: 1452)<br>(SEQ ID NO: 3466)<br>(SEQ ID NO: 5480) |
| LDHA-533 | 5'-UGGCAAAGACUAUAAUGUAACUGca-3'<br>3'-AGACCGUUUCUGAUAUUACAUUGACGU-5'<br>Target: 5'-TCTGGCAAAGACTATAATGTAACTGCA-3' | (SEQ ID NO: 1453)<br>(SEQ ID NO: 3467)<br>(SEQ ID NO: 5481) |
| LDHA-534 | 5'-GGCAAAGACUAUAAUGUAACUGCaa-3'<br>3'-GACCGUUUCUGAUAUUACAUUGACGUU-5'<br>Target: 5'-CTGGCAAAGACTATAATGTAACTGCAA-3' | (SEQ ID NO: 1454)<br>(SEQ ID NO: 3468)<br>(SEQ ID NO: 5482) |
| LDHA-535 | 5'-GCAAAGACUAUAAUGUAACUGCAaa-3'<br>3'-ACCGUUUCUGAUAUUACAUUGACGUUU-5'<br>Target: 5'-TGGCAAAGACTATAATGTAACTGCAAA-3' | (SEQ ID NO: 1455)<br>(SEQ ID NO: 3469)<br>(SEQ ID NO: 5483) |
| LDHA-536 | 5'-CAAAGACUAUAAUGUAACUGCAAac-3'<br>3'-CCGUUUCUGAUAUUACAUUGACGUUUG-5'<br>Target: 5'-GGCAAAGACTATAATGTAACTGCAAAC-3' | (SEQ ID NO: 1456)<br>(SEQ ID NO: 3470)<br>(SEQ ID NO: 5484) |
| LDHA-537 | 5'-AAAGACUAUAAUGUAACUGCAAAct-3'<br>3'-CGUUUCUGAUAUUACAUUGACGUUUGA-5'<br>Target: 5'-GCAAAGACTATAATGTAACTGCAAACT-3' | (SEQ ID NO: 1457)<br>(SEQ ID NO: 3471)<br>(SEQ ID NO: 5485) |
| LDHA-538 | 5'-AAGACUAUAAUGUAACUGCAAACtc-3'<br>3'-GUUUCUGAUAUUACAUUGACGUUUGAG-5'<br>Target: 5'-CAAAGACTATAATGTAACTGCAAACTC-3' | (SEQ ID NO: 1458)<br>(SEQ ID NO: 3472)<br>(SEQ ID NO: 5486) |
| LDHA-539 | 5'-AGACUAUAAUGUAACUGCAAACUcc-3'<br>3'-UUUCUGAUAUUACAUUGACGUUUGAGG-5'<br>Target: 5'-AAAGACTATAATGTAACTGCAAACTCC-3' | (SEQ ID NO: 1459)<br>(SEQ ID NO: 3473)<br>(SEQ ID NO: 5487) |
| LDHA-540 | 5'-GACUAUAAUGUAACUGCAAACUCca-3'<br>3'-UUCUGAUAUUACAUUGACGUUUGAGGU-5'<br>Target: 5'-AAGACTATAATGTAACTGCAAACTCCA-3' | (SEQ ID NO: 1460)<br>(SEQ ID NO: 3474)<br>(SEQ ID NO: 5488) |

TABLE 12-continued

Additional Selected Human Anti-Lactate Dehydrogenase DsiRNA Agents (Asymmetrics)

| | | |
|---|---|---|
| LDHA-541 Target: | 5'-ACUAUAAUGUAACUGCAAACUCCaa-3'<br>3'-UCUGAUAUUACAUUGACGUUUGAGGUU-5'<br>5'-AGACTATAATGTAACTGCAAACTCCAA-3' | (SEQ ID NO: 1461)<br>(SEQ ID NO: 3475)<br>(SEQ ID NO: 5489) |
| LDHA-542 Target: | 5'-CUAUAAUGUAACUGCAAACUCCAag-3'<br>3'-CUGAUAUUACAUUGACGUUUGAGGUUC-5'<br>5'-GACTATAATGTAACTGCAAACTCCAAG-3' | (SEQ ID NO: 1462)<br>(SEQ ID NO: 3476)<br>(SEQ ID NO: 5490) |
| LDHA-543 Target: | 5'-UAUAAUGUAACUGCAAACUCCAAgc-3'<br>3'-UGAUAUUACAUUGACGUUUGAGGUUCG-5'<br>5'-ACTATAATGTAACTGCAAACTCCAAGC-3' | (SEQ ID NO: 1463)<br>(SEQ ID NO: 3477)<br>(SEQ ID NO: 5491) |
| LDHA-544 Target: | 5'-AUAAUGUAACUGCAAACUCCAAGct-3'<br>3'-GAUAUUACAUUGACGUUUGAGGUUCGA-5'<br>5'-CTATAATGTAACTGCAAACTCCAAGCT-3' | (SEQ ID NO: 1464)<br>(SEQ ID NO: 3478)<br>(SEQ ID NO: 5492) |
| LDHA-545 Target: | 5'-UAAUGUAACUGCAAACUCCAAGCtg-3'<br>3'-AUAUUACAUUGACGUUUGAGGUUCGAC-5'<br>5'-TATAATGTAACTGCAAACTCCAAGCTG-3' | (SEQ ID NO: 1465)<br>(SEQ ID NO: 3479)<br>(SEQ ID NO: 5493) |
| LDHA-546 Target: | 5'-AAUGUAACUGCAAACUCCAAGCUgg-3'<br>3'-UAUUACAUUGACGUUUGAGGUUCGACC-5'<br>5'-ATAATGTAACTGCAAACTCCAAGCTGG-3' | (SEQ ID NO: 1466)<br>(SEQ ID NO: 3480)<br>(SEQ ID NO: 5494) |
| LDHA-547 Target: | 5'-AUGUAACUGCAAACUCCAAGCUGgt-3'<br>3'-AUUACAUUGACGUUUGAGGUUCGACCA-5'<br>5'-TAATGTAACTGCAAACTCCAAGCTGGT-3' | (SEQ ID NO: 1467)<br>(SEQ ID NO: 3481)<br>(SEQ ID NO: 5495) |
| LDHA-548 Target: | 5'-UGUAACUGCAAACUCCAAGCUGGtc-3'<br>3'-UUACAUUGACGUUUGAGGUUCGACCAG-5'<br>5'-AATGTAACTGCAAACTCCAAGCTGGTC-3' | (SEQ ID NO: 1468)<br>(SEQ ID NO: 3482)<br>(SEQ ID NO: 5496) |
| LDHA-549 Target: | 5'-GUAACUGCAAACUCCAAGCUGGUca-3'<br>3'-UACAUUGACGUUUGAGGUUCGACCAGU-5'<br>5'-ATGTAACTGCAAACTCCAAGCTGGTCA-3' | (SEQ ID NO: 1469)<br>(SEQ ID NO: 3483)<br>(SEQ ID NO: 5497) |
| LDHA-550 Target: | 5'-UAACUGCAAACUCCAAGCUGGUCat-3'<br>3'-ACAUUGACGUUUGAGGUUCGACCAGUA-5'<br>5'-TGTAACTGCAAACTCCAAGCTGGTCAT-3' | (SEQ ID NO: 1470)<br>(SEQ ID NO: 3484)<br>(SEQ ID NO: 5498) |
| LDHA-551 Target: | 5'-AACUGCAAACUCCAAGCUGGUCAtt-3'<br>3'-CAUUGACGUUUGAGGUUCGACCAGUAA-5'<br>5'-GTAACTGCAAACTCCAAGCTGGTCATT-3' | (SEQ ID NO: 1471)<br>(SEQ ID NO: 3485)<br>(SEQ ID NO: 5499) |
| LDHA-552 Target: | 5'-ACUGCAAACUCCAAGCUGGUCAUta-3'<br>3'-AUUGACGUUUGAGGUUCGACCAGUAAU-5'<br>5'-TAACTGCAAACTCCAAGCTGGTCATTA-3' | (SEQ ID NO: 1472)<br>(SEQ ID NO: 3486)<br>(SEQ ID NO: 5500) |
| LDHA-553 Target: | 5'-CUGCAAACUCCAAGCUGGUCAUUat-3'<br>3'-UUGACGUUUGAGGUUCGACCAGUAAUA-5'<br>5'-AACTGCAAACTCCAAGCTGGTCATTAT-3' | (SEQ ID NO: 1473)<br>(SEQ ID NO: 3487)<br>(SEQ ID NO: 5501) |
| LDHA-554 Target: | 5'-UGCAAACUCCAAGCUGGUCAUUAtc-3'<br>3'-UGACGUUUGAGGUUCGACCAGUAAUAG-5'<br>5'-ACTGCAAACTCCAAGCTGGTCATTATC-3' | (SEQ ID NO: 1474)<br>(SEQ ID NO: 3488)<br>(SEQ ID NO: 5502) |
| LDHA-555 Target: | 5'-GCAAACUCCAAGCUGGUCAUUAUca-3'<br>3'-GACGUUUGAGGUUCGACCAGUAAUAGU-5'<br>5'-CTGCAAACTCCAAGCTGGTCATTATCA-3' | (SEQ ID NO: 1475)<br>(SEQ ID NO: 3489)<br>(SEQ ID NO: 5503) |
| LDHA-556 Target: | 5'-CAAACUCCAAGCUGGUCAUUAUCac-3'<br>3'-ACGUUUGAGGUUCGACCAGUAAUAGUG-5'<br>5'-TGCAAACTCCAAGCTGGTCATTATCAC-3' | (SEQ ID NO: 1476)<br>(SEQ ID NO: 3490)<br>(SEQ ID NO: 5504) |
| LDHA-557 Target: | 5'-AAACUCCAAGCUGGUCAUUAUCAcg-3'<br>3'-CGUUUGAGGUUCGACCAGUAAUAGUGC-5'<br>5'-GCAAACTCCAAGCTGGTCATTATCACG-3' | (SEQ ID NO: 1477)<br>(SEQ ID NO: 3491)<br>(SEQ ID NO: 5505) |
| LDHA-558 Target: | 5'-AACUCCAAGCUGGUCAUUAUCACgg-3'<br>3'-GUUUGAGGUUCGACCAGUAAUAGUGCC-5'<br>5'-CAAACTCCAAGCTGGTCATTATCACGG-3' | (SEQ ID NO: 1478)<br>(SEQ ID NO: 3492)<br>(SEQ ID NO: 5506) |
| LDHA-559 Target: | 5'-ACUCCAAGCUGGUCAUUAUCACGgc-3'<br>3'-UUUGAGGUUCGACCAGUAAUAGUGCCG-5'<br>5'-AAACTCCAAGCTGGTCATTATCACGGC-3' | (SEQ ID NO: 1479)<br>(SEQ ID NO: 3493)<br>(SEQ ID NO: 5507) |

TABLE 12-continued

Additional Selected Human Anti-Lactate Dehydrogenase DsiRNA Agents (Asymmetrics)

| | | |
|---|---|---|
| LDHA-560 Target: | 5'-CUCCAAGCUGGUCAUUAUCACGGct-3'<br>3'-UUGAGGUUCGACCAGUAAUAGUGCCGA-5'<br>5'-AACTCCAAGCTGGTCATTATCACGGCT-3' | (SEQ ID NO: 1480)<br>(SEQ ID NO: 3494)<br>(SEQ ID NO: 5508) |
| LDHA-561 Target: | 5'-UCCAAGCUGGUCAUUAUCACGGCtg-3'<br>3'-UGAGGUUCGACCAGUAAUAGUGCCGAC-5'<br>5'-ACTCCAAGCTGGTCATTATCACGGCTG-3' | (SEQ ID NO: 1481)<br>(SEQ ID NO: 3495)<br>(SEQ ID NO: 5509) |
| LDHA-562 Target: | 5'-CCAAGCUGGUCAUUAUCACGGCUgg-3'<br>3'-GAGGUUCGACCAGUAAUAGUGCCGACC-5'<br>5'-CTCCAAGCTGGTCATTATCACGGCTGG-3' | (SEQ ID NO: 1482)<br>(SEQ ID NO: 3496)<br>(SEQ ID NO: 5510) |
| LDHA-563 Target: | 5'-CAAGCUGGUCAUUAUCACGGCUGgg-3'<br>3'-AGGUUCGACCAGUAAUAGUGCCGACCC-5'<br>5'-TCCAAGCTGGTCATTATCACGGCTGGG-3' | (SEQ ID NO: 1483)<br>(SEQ ID NO: 3497)<br>(SEQ ID NO: 5511) |
| LDHA-564 Target: | 5'-AAGCUGGUCAUUAUCACGGCUGGgg-3'<br>3'-GGUUCGACCAGUAAUAGUGCCGACCCC-5'<br>5'-CCAAGCTGGTCATTATCACGGCTGGGG-3' | (SEQ ID NO: 1484)<br>(SEQ ID NO: 3498)<br>(SEQ ID NO: 5512) |
| LDHA-565 Target: | 5'-AGCUGGUCAUUAUCACGGCUGGGgc-3'<br>3'-GUUCGACCAGUAAUAGUGCCGACCCCG-5'<br>5'-CAAGCTGGTCATTATCACGGCTGGGGC-3' | (SEQ ID NO: 1485)<br>(SEQ ID NO: 3499)<br>(SEQ ID NO: 5513) |
| LDHA-566 Target: | 5'-GCUGGUCAUUAUCACGGCUGGGGca-3'<br>3'-UUCGACCAGUAAUAGUGCCGACCCCGU-5'<br>5'-AAGCTGGTCATTATCACGGCTGGGGCA-3' | (SEQ ID NO: 1486)<br>(SEQ ID NO: 3500)<br>(SEQ ID NO: 5514) |
| LDHA-567 Target: | 5'-CUGGUCAUUAUCACGGCUGGGGCac-3'<br>3'-UCGACCAGUAAUAGUGCCGACCCCGUG-5'<br>5'-AGCTGGTCATTATCACGGCTGGGGCAC-3' | (SEQ ID NO: 1487)<br>(SEQ ID NO: 3501)<br>(SEQ ID NO: 5515) |
| LDHA-568 Target: | 5'-UGGUCAUUAUCACGGCUGGGGCAcg-3'<br>3'-CGACCAGUAAUAGUGCCGACCCCGUGC-5'<br>5'-GCTGGTCATTATCACGGCTGGGGCACG-3' | (SEQ ID NO: 1488)<br>(SEQ ID NO: 3502)<br>(SEQ ID NO: 5516) |
| LDHA-569 Target: | 5'-GGUCAUUAUCACGGCUGGGGCACgt-3'<br>3'-GACCAGUAAUAGUGCCGACCCCGUGCA-5'<br>5'-CTGGTCATTATCACGGCTGGGGCACGT-3' | (SEQ ID NO: 1489)<br>(SEQ ID NO: 3503)<br>(SEQ ID NO: 5517) |
| LDHA-570 Target: | 5'-GUCAUUAUCACGGCUGGGGCACGtc-3'<br>3'-ACCAGUAAUAGUGCCGACCCCGUGCAG-5'<br>5'-TGGTCATTATCACGGCTGGGGCACGTC-3' | (SEQ ID NO: 1490)<br>(SEQ ID NO: 3504)<br>(SEQ ID NO: 5518) |
| LDHA-571 Target: | 5'-UCAUUAUCACGGCUGGGGCACGUca-3'<br>3'-CCAGUAAUAGUGCCGACCCCGUGCAGU-5'<br>5'-GGTCATTATCACGGCTGGGGCACGTCA-3' | (SEQ ID NO: 1491)<br>(SEQ ID NO: 3505)<br>(SEQ ID NO: 5519) |
| LDHA-572 Target: | 5'-CAUUAUCACGGCUGGGGCACGUCag-3'<br>3'-CAGUAAUAGUGCCGACCCCGUGCAGUC-5'<br>5'-GTCATTATCACGGCTGGGGCACGTCAG-3' | (SEQ ID NO: 1492)<br>(SEQ ID NO: 3506)<br>(SEQ ID NO: 5520) |
| LDHA-573 Target: | 5'-AUUAUCACGGCUGGGGCACGUCAgc-3'<br>3'-AGUAAUAGUGCCGACCCCGUGCAGUCG-5'<br>5'-TCATTATCACGGCTGGGGCACGTCAGC-3' | (SEQ ID NO: 1493)<br>(SEQ ID NO: 3507)<br>(SEQ ID NO: 5521) |
| LDHA-574 Target: | 5'-UUAUCACGGCUGGGGCACGUCAGca-3'<br>3'-GUAAUAGUGCCGACCCCGUGCAGUCGU-5'<br>5'-CATTATCACGGCTGGGGCACGTCAGCA-3' | (SEQ ID NO: 1494)<br>(SEQ ID NO: 3508)<br>(SEQ ID NO: 5522) |
| LDHA-575 Target: | 5'-UAUCACGGCUGGGGCACGUCAGCaa-3'<br>3'-UAAUAGUGCCGACCCCGUGCAGUCGUU-5'<br>5'-ATTATCACGGCTGGGGCACGTCAGCAA-3' | (SEQ ID NO: 1495)<br>(SEQ ID NO: 3509)<br>(SEQ ID NO: 5523) |
| LDHA-576 Target: | 5'-AUCACGGCUGGGGCACGUCAGCAag-3'<br>3'-AAUAGUGCCGACCCCGUGCAGUCGUUC-5'<br>5'-TTATCACGGCTGGGGCACGTCAGCAAG-3' | (SEQ ID NO: 1496)<br>(SEQ ID NO: 3510)<br>(SEQ ID NO: 5524) |
| LDHA-577 Target: | 5'-UCACGGCUGGGGCACGUCAGCAAga-3'<br>3'-AUAGUGCCGACCCCGUGCAGUCGUUCU-5'<br>5'-TATCACGGCTGGGGCACGTCAGCAAGA-3' | (SEQ ID NO: 1497)<br>(SEQ ID NO: 3511)<br>(SEQ ID NO: 5525) |
| LDHA-578 Target: | 5'-CACGGCUGGGGCACGUCAGCAAGag-3'<br>3'-UAGUGCCGACCCCGUGCAGUCGUUCUC-5'<br>5'-ATCACGGCTGGGGCACGTCAGCAAGAG-3' | (SEQ ID NO: 1498)<br>(SEQ ID NO: 3512)<br>(SEQ ID NO: 5526) |

TABLE 12-continued

Additional Selected Human Anti-Lactate Dehydrogenase DsiRNA Agents (Asymmetrics)

| | | |
|---|---|---|
| LDHA-579 Target: | 5'-ACGGCUGGGGCACGUCAGCAAGAgg-3'<br>3'-AGUGCCGACCCCGUGCAGUCGUUCUCCC-5'<br>5'-TCACGGCTGGGGCACGTCAGCAAGAGG-3' | (SEQ ID NO: 1499)<br>(SEQ ID NO: 3513)<br>(SEQ ID NO: 5527) |
| LDHA-580 Target: | 5'-CGGCUGGGGCACGUCAGCAAGAGgg-3'<br>3'-GUGCCGACCCCGUGCAGUCGUUCUCCC-5'<br>5'-CACGGCTGGGGCACGTCAGCAAGAGGG-3' | (SEQ ID NO: 1500)<br>(SEQ ID NO: 3514)<br>(SEQ ID NO: 5528) |
| LDHA-581 Target: | 5'-GGCUGGGGCACGUCAGCAAGAGGga-3'<br>3'-UGCCGACCCCGUGCAGUCGUUCUCCCU-5'<br>5'-ACGGCTGGGGCACGTCAGCAAGAGGGA-3' | (SEQ ID NO: 1501)<br>(SEQ ID NO: 3515)<br>(SEQ ID NO: 5529) |
| LDHA-582 Target: | 5'-GCUGGGGCACGUCAGCAAGAGGGag-3'<br>3'-GCCGACCCCGUGCAGUCGUUCUCCCUC-5'<br>5'-CGGCTGGGGCACGTCAGCAAGAGGGAG-3' | (SEQ ID NO: 1502)<br>(SEQ ID NO: 3516)<br>(SEQ ID NO: 5530) |
| LDHA-583 Target: | 5'-CUGGGGCACGUCAGCAAGAGGGAga-3'<br>3'-CCGACCCCGUGCAGUCGUUCUCCCUCU-5'<br>5'-GGCTGGGGCACGTCAGCAAGAGGGAGA-3' | (SEQ ID NO: 1503)<br>(SEQ ID NO: 3517)<br>(SEQ ID NO: 5531) |
| LDHA-584 Target: | 5'-UGGGGCACGUCAGCAAGAGGGAGaa-3'<br>3'-CGACCCCGUGCAGUCGUUCUCCCUCUU-5'<br>5'-GCTGGGGCACGTCAGCAAGAGGGAGAA-3' | (SEQ ID NO: 1504)<br>(SEQ ID NO: 3518)<br>(SEQ ID NO: 5532) |
| LDHA-585 Target: | 5'-GGGGCACGUCAGCAAGAGGGAGAaa-3'<br>3'-GACCCCGUGCAGUCGUUCUCCCUCUUU-5'<br>5'-CTGGGGCACGTCAGCAAGAGGGAGAAA-3' | (SEQ ID NO: 1505)<br>(SEQ ID NO: 3519)<br>(SEQ ID NO: 5533) |
| LDHA-586 Target: | 5'-GGGCACGUCAGCAAGAGGGAGAAag-3'<br>3'-ACCCCGUGCAGUCGUUCUCCCUCUUUC-5'<br>5'-TGGGGCACGTCAGCAAGAGGGAGAAAG-3' | (SEQ ID NO: 1506)<br>(SEQ ID NO: 3520)<br>(SEQ ID NO: 5534) |
| LDHA-587 Target: | 5'-GGCACGUCAGCAAGAGGGAGAAAgc-3'<br>3'-CCCCGUGCAGUCGUUCUCCCUCUUUCG-5'<br>5'-GGGGCACGTCAGCAAGAGGGAGAAAGC-3' | (SEQ ID NO: 1507)<br>(SEQ ID NO: 3521)<br>(SEQ ID NO: 5535) |
| LDHA-588 Target: | 5'-GCACGUCAGCAAGAGGGAGAAAGcc-3'<br>3'-CCCGUGCAGUCGUUCUCCCUCUUUCGG-5'<br>5'-GGGCACGTCAGCAAGAGGGAGAAAGCC-3' | (SEQ ID NO: 1508)<br>(SEQ ID NO: 3522)<br>(SEQ ID NO: 5536) |
| LDHA-589 Target: | 5'-CACGUCAGCAAGAGGGAGAAAGCcg-3'<br>3'-CCGUGCAGUCGUUCUCCCUCUUUCGGC-5'<br>5'-GGCACGTCAGCAAGAGGGAGAAAGCCG-3' | (SEQ ID NO: 1509)<br>(SEQ ID NO: 3523)<br>(SEQ ID NO: 5537) |
| LDHA-590 Target: | 5'-ACGUCAGCAAGAGGGAGAAAGCCgt-3'<br>3'-CGUGCAGUCGUUCUCCCUCUUUCGGCA-5'<br>5'-GCACGTCAGCAAGAGGGAGAAAGCCGT-3' | (SEQ ID NO: 1510)<br>(SEQ ID NO: 3524)<br>(SEQ ID NO: 5538) |
| LDHA-591 Target: | 5'-CGUCAGCAAGAGGGAGAAAGCCGtc-3'<br>3'-GUGCAGUCGUUCUCCCUCUUUCGGCAG-5'<br>5'-CACGTCAGCAAGAGGGAGAAAGCCGTC-3' | (SEQ ID NO: 1511)<br>(SEQ ID NO: 3525)<br>(SEQ ID NO: 5539) |
| LDHA-592 Target: | 5'-GUCAGCAAGAGGGAGAAAGCCGUct-3'<br>3'-UGCAGUCGUUCUCCCUCUUUCGGCAGA-5'<br>5'-ACGTCAGCAAGAGGGAGAAAGCCGTCT-3' | (SEQ ID NO: 1512)<br>(SEQ ID NO: 3526)<br>(SEQ ID NO: 5540) |
| LDHA-593 Target: | 5'-UCAGCAAGAGGGAGAAAGCCGUCtt-3'<br>3'-GCAGUCGUUCUCCCUCUUUCGGCAGAA-5'<br>5'-CGTCAGCAAGAGGGAGAAAGCCGTCTT-3' | (SEQ ID NO: 1513)<br>(SEQ ID NO: 3527)<br>(SEQ ID NO: 5541) |
| LDHA-594 Target: | 5'-CAGCAAGAGGGAGAAAGCCGUCUta-3'<br>3'-CAGUCGUUCUCCCUCUUUCGGCAGAAU-5'<br>5'-GTCAGCAAGAGGGAGAAAGCCGTCTTA-3' | (SEQ ID NO: 1514)<br>(SEQ ID NO: 3528)<br>(SEQ ID NO: 5542) |
| LDHA-595 Target: | 5'-AGCAAGAGGGAGAAAGCCGUCUUaa-3'<br>3'-AGUCGUUCUCCCUCUUUCGGCAGAAUU-5'<br>5'-TCAGCAAGAGGGAGAAAGCCGTCTTAA-3' | (SEQ ID NO: 1515)<br>(SEQ ID NO: 3529)<br>(SEQ ID NO: 5543) |
| LDHA-596 Target: | 5'-GCAAGAGGGAGAAAGCCGUCUUAat-3'<br>3'-GUCGUUCUCCCUCUUUCGGCAGAAUUA-5'<br>5'-CAGCAAGAGGGAGAAAGCCGTCTTAAT-3' | (SEQ ID NO: 1516)<br>(SEQ ID NO: 3530)<br>(SEQ ID NO: 5544) |
| LDHA-597 Target: | 5'-CAAGAGGGAGAAAGCCGUCUUAatt-3'<br>3'-UCGUUCUCCCUCUUUCGGCAGAAUUAA-5'<br>5'-AGCAAGAGGGAGAAAGCCGTCTTAATT-3' | (SEQ ID NO: 1517)<br>(SEQ ID NO: 3531)<br>(SEQ ID NO: 5545) |

TABLE 12-continued

Additional Selected Human Anti-Lactate Dehydrogenase DsiRNA Agents (Asymmetrics)

| | | |
|---|---|---|
| LDHA-598 Target: | 5'-A<u>AGAGG</u>GAGAAAGC<u>CG</u>UCUUAAUtt-3'<br>3'-<u>CGUUCUCCC</u>UCUUU<u>CGG</u>CAGAAUU<u>AAAA</u>-5'<br>5'-GCAAGAGGGAGAAAGCCGTCTTAATTT-3' | (SEQ ID NO: 1518)<br>(SEQ ID NO: 3532)<br>(SEQ ID NO: 5546) |
| LDHA-599 Target: | 5'-A<u>GA</u>GGGAGAAAGC<u>CG</u>UCUUAAUUtg-3'<br>3'-<u>GUUCUCCC</u>UCUUU<u>CGG</u>CAGAAUU<u>AAAC</u>-5'<br>5'-CAAGAGGGAGAAAGCCGTCTTAATTTG-3' | (SEQ ID NO: 1519)<br>(SEQ ID NO: 3533)<br>(SEQ ID NO: 5547) |
| LDHA-600 Target: | 5'-<u>GA</u>GGGAGAAAGCC<u>GU</u>CUUAAUUUgg-3'<br>3'-<u>UUCUCCC</u>UCUUUCGG<u>C</u>AGAAUU<u>AAACC</u>-5'<br>5'-AAGAGGGAGAAAGCCGTCTTAATTTGG-3' | (SEQ ID NO: 1520)<br>(SEQ ID NO: 3534)<br>(SEQ ID NO: 5548) |
| LDHA-601 Target: | 5'-<u>A</u>GGGAGAAAGCCG<u>UC</u>UUAAUUUGgt-3'<br>3'-<u>UCUCCC</u>UCUUUCGGCAGAAUU<u>AAACCA</u>-5'<br>5'-AGAGGGAGAAAGCCGTCTTAATTTGGT-3' | (SEQ ID NO: 1521)<br>(SEQ ID NO: 3535)<br>(SEQ ID NO: 5549) |
| LDHA-602 Target: | 5'-GGGAGAAAGCCGU<u>C</u>UUAAUUUGGtc-3'<br>3'-<u>CUCCC</u>UCUUUCGGC<u>A</u>GAAUUAAAC<u>CAG</u>-5'<br>5'-GAGGGAGAAAGCCGTCTTAATTTGGTC-3' | (SEQ ID NO: 1522)<br>(SEQ ID NO: 3536)<br>(SEQ ID NO: 5550) |
| LDHA-603 Target: | 5'-GG<u>A</u>GAAAGCCGUC<u>UU</u>A<u>A</u>UUUGGUcc-3'<br>3'-<u>UCCC</u>UCUUUCGGC<u>A</u>G<u>A</u>AUUAAACCA<u>GG</u>-5'<br>5'-AGGGAGAAAGCCGTCTTAATTTGGTCC-3' | (SEQ ID NO: 1523)<br>(SEQ ID NO: 3537)<br>(SEQ ID NO: 5551) |
| LDHA-604 Target: | 5'-GAGAAAGCCGUCUU<u>AA</u>UUUGGUCca-3'<br>3'-<u>CCCU</u>CUUUCGGCAG<u>AA</u>UUAAACCAG<u>GU</u>-5'<br>5'-GGGAGAAAGCCGTCTTAATTTGGTCCA-3' | (SEQ ID NO: 1524)<br>(SEQ ID NO: 3538)<br>(SEQ ID NO: 5552) |
| LDHA-605 Target: | 5'-AGAAAGCCGUCUU<u>A</u>AU<u>UU</u>GGUCCag-3'<br>3'-<u>CCU</u>CUUUCGGCAGA<u>A</u>UU<u>AAA</u>CCAGG<u>UC</u>-5'<br>5'-GGAGAAAGCCGTCTTAATTTGGTCCAG-3' | (SEQ ID NO: 1525)<br>(SEQ ID NO: 3539)<br>(SEQ ID NO: 5553) |
| LDHA-606 Target: | 5'-G<u>AA</u>AGCCGUCUUA<u>AU</u>UUGGUCCAgc-3'<br>3'-<u>CUCU</u>UUCGGCAGAAUU<u>AAACC</u>AGG<u>UCG</u>-5'<br>5'-GAGAAAGCCGTCTTAATTTGGTCCAGC-3' | (SEQ ID NO: 1526)<br>(SEQ ID NO: 3540)<br>(SEQ ID NO: 5554) |
| LDHA-607 Target: | 5'-A<u>AA</u>GCCGUCUUA<u>AU</u>UUGGUCCAGcg-3'<br>3'-<u>UCUU</u>UCGGCAGAAUU<u>AAA</u>CCAGG<u>UCGC</u>-5'<br>5'-AGAAAGCCGTCTTAATTTGGTCCAGCG-3' | (SEQ ID NO: 1527)<br>(SEQ ID NO: 3541)<br>(SEQ ID NO: 5555) |
| LDHA-608 Target: | 5'-A<u>A</u>GCCGUCUUAAU<u>UU</u>GGUCCAGCgt-3'<br>3'-<u>CUUU</u>CGGCAGAAUU<u>AAA</u>CCAGGUCG<u>CA</u>-5'<br>5'-GAAAGCCGTCTTAATTTGGTCCAGCGT-3' | (SEQ ID NO: 1528)<br>(SEQ ID NO: 3542)<br>(SEQ ID NO: 5556) |
| LDHA-609 Target: | 5'-A<u>G</u>CCGUCUUAAUU<u>UG</u>GUCCAGCGta-3'<br>3'-<u>UUUC</u>GGCAGAAUUA<u>AA</u>CCAGGUCG<u>CAU</u>-5'<br>5'-AAAGCCGTCTTAATTTGGTCCAGCGTA-3' | (SEQ ID NO: 1529)<br>(SEQ ID NO: 3543)<br>(SEQ ID NO: 5557) |
| LDHA-610 Target: | 5'-G<u>CC</u>GUCUAUUUG<u>GU</u>CCAGCGUaa-3'<br>3'-<u>UUCG</u>GCAGAAUUA<u>AAC</u>CAGGUCG<u>CAUU</u>-5'<br>5'-AAGCCGTCTTAATTTGGTCCAGCGTAA-3' | (SEQ ID NO: 1530)<br>(SEQ ID NO: 3544)<br>(SEQ ID NO: 5558) |
| LDHA-611 Target: | 5'-C<u>C</u>GUCUUAAUUUGG<u>UC</u>CAGCGUAac-3'<br>3'-<u>UCGG</u>CAGAAUUAAA<u>CC</u>AGGUCGC<u>AUUG</u>-5'<br>5'-AGCCGTCTTAATTTGGTCCAGCGTAAC-3' | (SEQ ID NO: 1531)<br>(SEQ ID NO: 3545)<br>(SEQ ID NO: 5559) |
| LDHA-612 Target: | 5'-C<u>GU</u>CUUAAUUUGG<u>UCC</u>AGCGUAAcg-3'<br>3'-<u>CGG</u>CAGAAUUAAA<u>CC</u>AGGUCGC<u>AUUGC</u>-5'<br>5'-GCCGTCTTAATTTGGTCCAGCGTAACG-3' | (SEQ ID NO: 1532)<br>(SEQ ID NO: 3546)<br>(SEQ ID NO: 5560) |
| LDHA-613 Target: | 5'-G<u>U</u>CUUAAUUUGGUC<u>C</u>AGCGUAACgt-3'<br>3'-<u>GG</u>CAGAAUUAAACCAGGUCGCAUU<u>GCA</u>-5'<br>5'-CCGTCTTAATTTGGTCCAGCGTAACGT-3' | (SEQ ID NO: 1533)<br>(SEQ ID NO: 3547)<br>(SEQ ID NO: 5561) |
| LDHA-614 Target: | 5'-<u>U</u>CUUAAUUUGGUCC<u>A</u>GCGUAACGtg-3'<br>3'-<u>GCA</u>GAAUUAAACCAGGUCGCAUUG<u>CAC</u>-5'<br>5'-CGTCTTAATTTGGTCCAGCGTAACGTG-3' | (SEQ ID NO: 1534)<br>(SEQ ID NO: 3548)<br>(SEQ ID NO: 5562) |
| LDHA-615 Target: | 5'-C<u>UU</u>AAUUUGGUCC<u>AG</u>CGUAACGUga-3'<br>3'-<u>CAGA</u>AUUAAACCAGG<u>U</u>CGCAUUG<u>CACU</u>-5'<br>5'-GTCTTAATTTGGTCCAGCGTAACGTGA-3' | (SEQ ID NO: 1535)<br>(SEQ ID NO: 3549)<br>(SEQ ID NO: 5563) |
| LDHA-616 Target: | 5'-U<u>UA</u>AUUUGGUCC<u>AG</u>CGUAACGUGaa-3'<br>3'-<u>AGAA</u>UUAAACCAGG<u>UC</u>GCAUUGC<u>ACUU</u>-5'<br>5'-TCTTAATTTGGTCCAGCGTAACGTGAA-3' | (SEQ ID NO: 1536)<br>(SEQ ID NO: 3550)<br>(SEQ ID NO: 5564) |

TABLE 12-continued

Additional Selected Human Anti-Lactate Dehydrogenase DsiRNA Agents (Asymmetrics)

|  |  |  |
| --- | --- | --- |
| LDHA-617 Target: | 5'-UAAUUUGGUCCAGCGUAACGUGAac-3'<br>3'-GAAUUAAACCAGGUCGCAUUGCACUUG-5'<br>5'-CTTAATTTGGTCCAGCGTAACGTGAAC-3' | (SEQ ID NO: 1537)<br>(SEQ ID NO: 3551)<br>(SEQ ID NO: 5565) |
| LDHA-618 Target: | 5'-AAUUUGGUCCAGCGUAACGUGAAca-3'<br>3'-AAUUAAACCAGGUCGCAUUGCACUUGU-5'<br>5'-TTAATTTGGTCCAGCGTAACGTGAACA-3' | (SEQ ID NO: 1538)<br>(SEQ ID NO: 3552)<br>(SEQ ID NO: 5566) |
| LDHA-619 Target: | 5'-AUUUGGUCCAGCGUAACGUGAACat-3'<br>3'-AUUAAACCAGGUCGCAUUGCACUUGUA-5'<br>5'-TAATTTGGTCCAGCGTAACGTGAACAT-3' | (SEQ ID NO: 1539)<br>(SEQ ID NO: 3553)<br>(SEQ ID NO: 5567) |
| LDHA-620 Target: | 5'-UUUGGUCCAGCGUAACGUGAACAtc-3'<br>3'-UUAAACCAGGUCGCAUUGCACUUGUAG-5'<br>5'-AATTTGGTCCAGCGTAACGTGAACATC-3' | (SEQ ID NO: 1540)<br>(SEQ ID NO: 3554)<br>(SEQ ID NO: 5568) |
| LDHA-621 Target: | 5'-UUGGUCCAGCGUAACGUGAACAUct-3'<br>3'-UAAACCAGGUCGCAUUGCACUUGUAGA-5'<br>5'-ATTTGGTCCAGCGTAACGTGAACATCT-3' | (SEQ ID NO: 1541)<br>(SEQ ID NO: 3555)<br>(SEQ ID NO: 5569) |
| LDHA-622 Target: | 5'-UGGUCCAGCGUAACGUGAACAUCtt-3'<br>3'-AAACCAGGUCGCAUUGCACUUGUAGAA-5'<br>5'-TTTGGTCCAGCGTAACGTGAACATCTT-3' | (SEQ ID NO: 1542)<br>(SEQ ID NO: 3556)<br>(SEQ ID NO: 5570) |
| LDHA-623 Target: | 5'-GGUCCAGCGUAACGUGAACAUCUtt-3'<br>3'-AACCAGGUCGCAUUGCACUUGUAGAAA-5'<br>5'-TTGGTCCAGCGTAACGTGAACATCTTT-3' | (SEQ ID NO: 1543)<br>(SEQ ID NO: 3557)<br>(SEQ ID NO: 5571) |
| LDHA-624 Target: | 5'-GUCCAGCGUAACGUGAACAUCUUta-3'<br>3'-ACCAGGUCGCAUUGCACUUGUAGAAAU-5'<br>5'-TGGTCCAGCGTAACGTGAACATCTTTA-3' | (SEQ ID NO: 1544)<br>(SEQ ID NO: 3558)<br>(SEQ ID NO: 5572) |
| LDHA-625 Target: | 5'-UCCAGCGUAACGUGAACAUCUUUaa-3'<br>3'-CCAGGUCGCAUUGCACUUGUAGAAAUU-5'<br>5'-GGTCCAGCGTAACGTGAACATCTTTAA-3' | (SEQ ID NO: 1545)<br>(SEQ ID NO: 3559)<br>(SEQ ID NO: 5573) |
| LDHA-626 Target: | 5'-CCAGCGUAACGUGAACAUCUUUAaa-3'<br>3'-CAGGUCGCAUUGCACUUGUAGAAAUUU-5'<br>5'-GTCCAGCGTAACGTGAACATCTTTAAA-3' | (SEQ ID NO: 1546)<br>(SEQ ID NO: 3560)<br>(SEQ ID NO: 5574) |
| LDHA-627 Target: | 5'-CAGCGUAACGUGAACAUCUUUAAat-3'<br>3'-AGGUCGCAUUGCACUUGUAGAAAUUUA-5'<br>5'-TCCAGCGTAACGTGAACATCTTTAAAT-3' | (SEQ ID NO: 1547)<br>(SEQ ID NO: 3561)<br>(SEQ ID NO: 5575) |
| LDHA-628 Target: | 5'-AGCGUAACGUGAACAUCUUUAAAtt-3'<br>3'-GGUCGCAUUGCACUUGUAGAAAUUUAA-5'<br>5'-CCAGCGTAACGTGAACATCTTTAAATT-3' | (SEQ ID NO: 1548)<br>(SEQ ID NO: 3562)<br>(SEQ ID NO: 5576) |
| LDHA-629 Target: | 5'-GCGUAACGUGAACAUCUUUAAAUtc-3'<br>3'-GUCGCAUUGCACUUGUAGAAAUUUAAG-5'<br>5'-CAGCGTAACGTGAACATCTTTAAATTC-3' | (SEQ ID NO: 1549)<br>(SEQ ID NO: 3563)<br>(SEQ ID NO: 5577) |
| LDHA-630 Target: | 5'-CGUAACGUGAACAUCUUUAAAUUca-3'<br>3'-UCGCAUUGCACUUGUAGAAAUUUAAGU-5'<br>5'-AGCGTAACGTGAACATCTTTAAATTCA-3' | (SEQ ID NO: 1550)<br>(SEQ ID NO: 3564)<br>(SEQ ID NO: 5578) |
| LDHA-631 Target: | 5'-GUAACGUGAACAUCUUUAAAUUCat-3'<br>3'-CGCAUUGCACUUGUAGAAAUUUAAGUA-5'<br>5'-GCGTAACGTGAACATCTTTAAATTCAT-3' | (SEQ ID NO: 1551)<br>(SEQ ID NO: 3565)<br>(SEQ ID NO: 5579) |
| LDHA-632 Target: | 5'-UAACGUGAACAUCUUUAAAUUCAtc-3'<br>3'-GCAUUGCACUUGUAGAAAUUUAAGUAG-5'<br>5'-CGTAACGTGAACATCTTTAAATTCATC-3' | (SEQ ID NO: 1552)<br>(SEQ ID NO: 3566)<br>(SEQ ID NO: 5580) |
| LDHA-633 Target: | 5'-AACGUGAACAUCUUUAAAUUCAUca-3'<br>3'-CAUUGCACUUGUAGAAAUUUAAGUAGU-5'<br>5'-GTAACGTGAACATCTTTAAATTCATCA-3' | (SEQ ID NO: 1553)<br>(SEQ ID NO: 3567)<br>(SEQ ID NO: 5581) |
| LDHA-634 Target: | 5'-ACGUGAACAUCUUUAAAUUCAUCat-3'<br>3'-AUUGCACUUGUAGAAAUUUAAGUAGUA-5'<br>5'-TAACGTGAACATCTTTAAATTCATCAT-3' | (SEQ ID NO: 1554)<br>(SEQ ID NO: 3568)<br>(SEQ ID NO: 5582) |
| LDHA-635 Target: | 5'-CGUGAACAUCUUUAAAUUCAUCAtt-3'<br>3'-UUGCACUUGUAGAAAUUUAAGUAGUAA-5'<br>5'-AACGTGAACATCTTTAAATTCATCATT-3' | (SEQ ID NO: 1555)<br>(SEQ ID NO: 3569)<br>(SEQ ID NO: 5583) |

TABLE 12-continued

Additional Selected Human Anti-Lactate Dehydrogenase DsiRNA Agents (Asymmetrics)

| | | |
|---|---|---|
| LDHA-636 Target: | 5'-GUGAACAUCUUUAAAUUCAUCAUtc-3'<br>3'-UGCACUUGUAGAAAUUUAAGUAGUAAG-5'<br>5'-ACGTGAACATCTTTAAATTCATCATTC-3' | (SEQ ID NO: 1556)<br>(SEQ ID NO: 3570)<br>(SEQ ID NO: 5584) |
| LDHA-637 Target: | 5'-UGAACAUCUUUAAAUUCAUCAUUcc-3'<br>3'-GCACUUGUAGAAAUUUAAGUAGUAAGG-5'<br>5'-CGTGAACATCTTTAAATTCATCATTCC-3' | (SEQ ID NO: 1557)<br>(SEQ ID NO: 3571)<br>(SEQ ID NO: 5585) |
| LDHA-638 Target: | 5'-GAACAUCUUUAAAUUCAUCAUUCct-3'<br>3'-CACUUGUAGAAAUUUAAGUAGUAAGGA-5'<br>5'-GTGAACATCTTTAAATTCATCATTCCT-3' | (SEQ ID NO: 1558)<br>(SEQ ID NO: 3572)<br>(SEQ ID NO: 5586) |
| LDHA-639 Target: | 5'-AACAUCUUUAAAUUCAUCAUUCCta-3'<br>3'-ACUUGUAGAAAUUUAAGUAGUAAGGAU-5'<br>5'-TGAACATCTTTAAATTCATCATTCCTA-3' | (SEQ ID NO: 1559)<br>(SEQ ID NO: 3573)<br>(SEQ ID NO: 5587) |
| LDHA-640 Target: | 5'-ACAUCUUUAAAUUCAUCAUUCCUaa-3'<br>3'-CUUGUAGAAAUUUAAGUAGUAAGGAUU-5'<br>5'-GAACATCTTTAAATTCATCATTCCTAA-3' | (SEQ ID NO: 1560)<br>(SEQ ID NO: 3574)<br>(SEQ ID NO: 5588) |
| LDHA-641 Target: | 5'-CAUCUUUAAAUUCAUCAUUCCUAat-3'<br>3'-UUGUAGAAAUUUAAGUAGUAAGGAUUA-5'<br>5'-AACATCTTTAAATTCATCATTCCTAAT-3' | (SEQ ID NO: 1561)<br>(SEQ ID NO: 3575)<br>(SEQ ID NO: 5589) |
| LDHA-642 Target: | 5'-AUCUUUAAAUUCAUCAUUCCUAAtg-3'<br>3'-UGUAGAAAUUUAAGUAGUAAGGAUUAC-5'<br>5'-ACATCTTTAAATTCATCATTCCTAATG-3' | (SEQ ID NO: 1562)<br>(SEQ ID NO: 3576)<br>(SEQ ID NO: 5590) |
| LDHA-643 Target: | 5'-UCUUUAAAUUCAUCAUUCCUAAUgt-3'<br>3'-GUAGAAAUUUAAGUAGUAAGGAUUACA-5'<br>5'-CATCTTTAAATTCATCATTCCTAATGT-3' | (SEQ ID NO: 1563)<br>(SEQ ID NO: 3577)<br>(SEQ ID NO: 5591) |
| LDHA-644 Target: | 5'-CUUUAAAUUCAUCAUUCCUAAUGtt-3'<br>3'-UAGAAAUUUAAGUAGUAAGGAUUACAA-5'<br>5'-ATCTTTAAATTCATCATTCCTAATGTT-3' | (SEQ ID NO: 1564)<br>(SEQ ID NO: 3578)<br>(SEQ ID NO: 5592) |
| LDHA-645 Target: | 5'-UUUAAAUUCAUCAUUCCUAAUGUtg-3'<br>3'-AGAAAUUUAAGUAGUAAGGAUUACAAC-5'<br>5'-TCTTTAAATTCATCATTCCTAATGTTG-3' | (SEQ ID NO: 1565)<br>(SEQ ID NO: 3579)<br>(SEQ ID NO: 5593) |
| LDHA-646 Target: | 5'-UUAAAUUCAUCAUUCCUAAUGUUgt-3'<br>3'-GAAAUUUAAGUAGUAAGGAUUACAACA-5'<br>5'-CTTTAAATTCATCATTCCTAATGTTGT-3' | (SEQ ID NO: 1566)<br>(SEQ ID NO: 3580)<br>(SEQ ID NO: 5594) |
| LDHA-647 Target: | 5'-UAAAUUCAUCAUUCCUAAUGUUGta-3'<br>3'-AAAUUUAAGUAGUAAGGAUUACAACAU-5'<br>5'-TTTAAATTCATCATTCCTAATGTTGTA-3' | (SEQ ID NO: 1567)<br>(SEQ ID NO: 3581)<br>(SEQ ID NO: 5595) |
| LDHA-648 Target: | 5'-AAAUUCAUCAUUCCUAAUGUUGUaa-3'<br>3'-AAUUUAAGUAGUAAGGAUUACAACAUU-5'<br>5'-TTAAATTCATCATTCCTAATGTTGTAA-3' | (SEQ ID NO: 1568)<br>(SEQ ID NO: 3582)<br>(SEQ ID NO: 5596) |
| LDHA-649 Target: | 5'-AAUUCAUCAUUCCUAAUGUUGUAaa-3'<br>3'-AUUUAAGUAGUAAGGAUUACAACAUUU-5'<br>5'-TAAATTCATCATTCCTAATGTTGTAAA-3' | (SEQ ID NO: 1569)<br>(SEQ ID NO: 3583)<br>(SEQ ID NO: 5597) |
| LDHA-650 Target: | 5'-AUUCAUCAUUCCUAAUGUUGUAAaa-3'<br>3'-UUUAAGUAGUAAGGAUUACAACAUUUU-5'<br>5'-AAATTCATCATTCCTAATGTTGTAAAA-3' | (SEQ ID NO: 1570)<br>(SEQ ID NO: 3584)<br>(SEQ ID NO: 5598) |
| LDHA-651 Target: | 5'-UUCAUCAUUCCUAAUGUUGUAAAat-3'<br>3'-UUAAGUAGUAAGGAUUACAACAUUUUA-5'<br>5'-AATTCATCATTCCTAATGTTGTAAAAT-3' | (SEQ ID NO: 1571)<br>(SEQ ID NO: 3585)<br>(SEQ ID NO: 5599) |
| LDHA-652 Target: | 5'-UCAUCAUUCCUAAUGUUGUAAAAta-3'<br>3'-UAAGUAGUAAGGAUUACAACAUUUUAU-5'<br>5'-ATTCATCATTCCTAATGTTGTAAAATA-3' | (SEQ ID NO: 1572)<br>(SEQ ID NO: 3586)<br>(SEQ ID NO: 5600) |
| LDHA-653 Target: | 5'-CAUCAUUCCUAAUGUUGUAAAAUac-3'<br>3'-AAGUAGUAAGGAUUACAACAUUUUAUG-5'<br>5'-TTCATCATTCCTAATGTTGTAAAATAC-3' | (SEQ ID NO: 1573)<br>(SEQ ID NO: 3587)<br>(SEQ ID NO: 5601) |
| LDHA-654 Target: | 5'-AUCAUUCCUAAUGUUGUAAAAUAca-3'<br>3'-AGUAGUAAGGAUUACAACAUUUUAUGU-5'<br>5'-TCATCATTCCTAATGTTGTAAAATACA-3' | (SEQ ID NO: 1574)<br>(SEQ ID NO: 3588)<br>(SEQ ID NO: 5602) |

TABLE 12-continued

Additional Selected Human Anti-Lactate Dehydrogenase DsiRNA Agents (Asymmetrics)

| | | |
|---|---|---|
| LDHA-655 | 5'-UCAUUCCUAAUGUUGUAAAAUACag-3'<br>3'-GUAGUAAGGAUUACAACAUUUUAUGUC-5'<br>Target: 5'-CATCATTCCTAATGTTGTAAAATACAG-3' | (SEQ ID NO: 1575)<br>(SEQ ID NO: 3589)<br>(SEQ ID NO: 5603) |
| LDHA-656 | 5'-CAUUCCUAAUGUUGUAAAAUACAgc-3'<br>3'-UAGUAAGGAUUACAACAUUUUAUGUCG-5'<br>Target: 5'-ATCATTCCTAATGTTGTAAAATACAGC-3' | (SEQ ID NO: 1576)<br>(SEQ ID NO: 3590)<br>(SEQ ID NO: 5604) |
| LDHA-657 | 5'-AUUCCUAAUGUUGUAAAAUACAGcc-3'<br>3'-AGUAAGGAUUACAACAUUUUAUGUCGG-5'<br>Target: 5'-TCATTCCTAATGTTGTAAAATACAGCC-3' | (SEQ ID NO: 1577)<br>(SEQ ID NO: 3591)<br>(SEQ ID NO: 5605) |
| LDHA-658 | 5'-UUCCUAAUGUUGUAAAAUACAGCcc-3'<br>3'-GUAAGGAUUACAACAUUUUAUGUCGGG-5'<br>Target: 5'-CATTCCTAATGTTGTAAAATACAGCCC-3' | (SEQ ID NO: 1578)<br>(SEQ ID NO: 3592)<br>(SEQ ID NO: 5606) |
| LDHA-659 | 5'-UCCUAAUGUUGUAAAAUACAGCCcg-3'<br>3'-UAAGGAUUACAACAUUUUAUGUCGGGC-5'<br>Target: 5'-ATTCCTAATGTTGTAAAATACAGCCCG-3' | (SEQ ID NO: 1579)<br>(SEQ ID NO: 3593)<br>(SEQ ID NO: 5607) |
| LDHA-660 | 5'-CCUAAUGUUGUAAAAUACAGCCCga-3'<br>3'-AAGGAUUACAACAUUUUAUGUCGGGCU-5'<br>Target: 5'-TTCCTAATGTTGTAAAATACAGCCCGA-3' | (SEQ ID NO: 1580)<br>(SEQ ID NO: 3594)<br>(SEQ ID NO: 5608) |
| LDHA-661 | 5'-CUAAUGUUGUAAAAUACAGCCCGaa-3'<br>3'-AGGAUUACAACAUUUUAUGUCGGGCUU-5'<br>Target: 5'-TCCTAATGTTGTAAAATACAGCCCGAA-3' | (SEQ ID NO: 1581)<br>(SEQ ID NO: 3595)<br>(SEQ ID NO: 5609) |
| LDHA-662 | 5'-UAAUGUUGUAAAAUACAGCCCGAac-3'<br>3'-GGAUUACAACAUUUUAUGUCGGGCUUG-5'<br>Target: 5'-CCTAATGTTGTAAAATACAGCCCGAAC-3' | (SEQ ID NO: 1582)<br>(SEQ ID NO: 3596)<br>(SEQ ID NO: 5610) |
| LDHA-663 | 5'-AAUGUUGUAAAAUACAGCCCGAAct-3'<br>3'-GAUUACAACAUUUUAUGUCGGGCUUGA-5'<br>Target: 5'-CTAATGTTGTAAAATACAGCCCGAACT-3' | (SEQ ID NO: 1583)<br>(SEQ ID NO: 3597)<br>(SEQ ID NO: 5611) |
| LDHA-664 | 5'-AUGUUGUAAAAUACAGCCCGAACtg-3'<br>3'-AUUACAACAUUUUAUGUCGGGCUUGAC-5'<br>Target: 5'-TAATGTTGTAAAATACAGCCCGAACTG-3' | (SEQ ID NO: 1584)<br>(SEQ ID NO: 3598)<br>(SEQ ID NO: 5612) |
| LDHA-665 | 5'-UGUUGUAAAAUACAGCCCGAACUgc-3'<br>3'-UUACAACAUUUUAUGUCGGGCUUGACG-5'<br>Target: 5'-AATGTTGTAAAATACAGCCCGAACTGC-3' | (SEQ ID NO: 1585)<br>(SEQ ID NO: 3599)<br>(SEQ ID NO: 5613) |
| LDHA-666 | 5'-GUUGUAAAAUACAGCCCGAACUGca-3'<br>3'-UACAACAUUUUAUGUCGGGCUUGACGU-5'<br>Target: 5'-ATGTTGTAAAATACAGCCCGAACTGCA-3' | (SEQ ID NO: 1586)<br>(SEQ ID NO: 3600)<br>(SEQ ID NO: 5614) |
| LDHA-667 | 5'-UUGUAAAAUACAGCCCGAACUGCaa-3'<br>3'-ACAACAUUUUAUGUCGGGCUUGACGUU-5'<br>Target: 5'-TGTTGTAAAATACAGCCCGAACTGCAA-3' | (SEQ ID NO: 1587)<br>(SEQ ID NO: 3601)<br>(SEQ ID NO: 5615) |
| LDHA-668 | 5'-UGUAAAAUACAGCCCGAACUGCAag-3'<br>3'-CAACAUUUUAUGUCGGGCUUGACGUUC-5'<br>Target: 5'-GTTGTAAAATACAGCCCGAACTGCAAG-3' | (SEQ ID NO: 1588)<br>(SEQ ID NO: 3602)<br>(SEQ ID NO: 5616) |
| LDHA-669 | 5'-GUAAAAUACAGCCCGAACUGCAAgt-3'<br>3'-AACAUUUUAUGUCGGGCUUGACGUUCA-5'<br>Target: 5'-TTGTAAAATACAGCCCGAACTGCAAGT-3' | (SEQ ID NO: 1589)<br>(SEQ ID NO: 3603)<br>(SEQ ID NO: 5617) |
| LDHA-670 | 5'-UAAAAUACAGCCCGAACUGCAAGtt-3'<br>3'-ACAUUUUAUGUCGGGCUUGACGUUCAA-5'<br>Target: 5'-TGTAAAATACAGCCCGAACTGCAAGTT-3' | (SEQ ID NO: 1590)<br>(SEQ ID NO: 3604)<br>(SEQ ID NO: 5618) |
| LDHA-671 | 5'-AAAAUACAGCCCGAACUGCAAGUtg-3'<br>3'-CAUUUUAUGUCGGGCUUGACGUUCAAC-5'<br>Target: 5'-GTAAAATACAGCCCGAACTGCAAGTTG-3' | (SEQ ID NO: 1591)<br>(SEQ ID NO: 3605)<br>(SEQ ID NO: 5619) |
| LDHA-672 | 5'-AAAUACAGCCCGAACUGCAAGUUgc-3'<br>3'-AUUUUAUGUCGGGCUUGACGUUCAACG-5'<br>Target: 5'-TAAAATACAGCCCGAACTGCAAGTTGC-3' | (SEQ ID NO: 1592)<br>(SEQ ID NO: 3606)<br>(SEQ ID NO: 5620) |
| LDHA-673 | 5'-AAUACAGCCCGAACUGCAAGUUGct-3'<br>3'-UUUUAUGUCGGGCUUGACGUUCAACGA-5'<br>Target: 5'-AAAATACAGCCCGAACTGCAAGTTGCT-3' | (SEQ ID NO: 1593)<br>(SEQ ID NO: 3607)<br>(SEQ ID NO: 5621) |

TABLE 12-continued

Additional Selected Human Anti-Lactate Dehydrogenase DsiRNA Agents (Asymmetrics)

| | | |
|---|---|---|
| LDHA-674 | 5'-A<u>U</u>A<u>C</u>AGCCCGAACU<u>GC</u>AAGUUGCtt-3'<br>3'-<u>UUUAUGUC</u>GGGCUUGA<u>C</u>GUUCAA<u>C</u>GAA-5'<br>Target: 5'-AAATACAGCCCGAACTGCAAGTTGCTT-3' | (SEQ ID NO: 1594)<br>(SEQ ID NO: 3608)<br>(SEQ ID NO: 5622) |
| LDHA-675 | 5'-<u>U</u>A<u>C</u>AGCCCGAACU<u>GC</u>AAGUUGCUta-3'<br>3'-<u>UUAUGUC</u>GGGCUUGA<u>C</u>GUUCAAC<u>G</u>AAU-5'<br>Target: 5'-AATACAGCCCGAACTGCAAGTTGCTTA-3' | (SEQ ID NO: 1595)<br>(SEQ ID NO: 3609)<br>(SEQ ID NO: 5623) |
| LDHA-676 | 5'-<u>A</u>C<u>A</u>GCCCGAACUGC<u>A</u>AGUUGCUUat-3'<br>3'-<u>UAUGUC</u>GGGCUUGA<u>C</u>GUUCAACG<u>AAUA</u>-5'<br>Target: 5'-ATACAGCCCGAACTGCAAGTTGCTTAT-3' | (SEQ ID NO: 1596)<br>(SEQ ID NO: 3610)<br>(SEQ ID NO: 5624) |
| LDHA-677 | 5'-<u>C</u>AGCCCGAACUGC<u>A</u>AGUUGCUUAtt-3'<br>3'-<u>AUGUC</u>GGGCUUGAC<u>G</u>UUCAACGA<u>AUAA</u>-5'<br>Target: 5'-TACAGCCCGAACTGCAAGTTGCTTATT-3' | (SEQ ID NO: 1597)<br>(SEQ ID NO: 3611)<br>(SEQ ID NO: 5625) |
| LDHA-678 | 5'-A<u>GCCC</u>GAACUGCA<u>A</u>GUUGCUUAUtg-3'<br>3'-<u>UGUC</u>GGGCUUGAC<u>GUU</u>CAACGAAU<u>AAC</u>-5'<br>Target: 5'-ACAGCCCGAACTGCAAGTTGCTTATTG-3' | (SEQ ID NO: 1598)<br>(SEQ ID NO: 3612)<br>(SEQ ID NO: 5626) |
| LDHA-679 | 5'-<u>GCCC</u>GAACUGCAA<u>G</u>UUGCUUAUUgt-3'<br>3'-<u>GUC</u>GGGCUUGACGUU<u>C</u>AACGAAUA<u>ACA</u>-5'<br>Target: 5'-CAGCCCGAACTGCAAGTTGCTTATTGT-3' | (SEQ ID NO: 1599)<br>(SEQ ID NO: 3613)<br>(SEQ ID NO: 5627) |
| LDHA-680 | 5'-<u>CCC</u>GAACUGCAAGU<u>U</u>GCUUAUUGtt-3'<br>3'-<u>UC</u>GGGCUUGACGUU<u>C</u>AACGAAUA<u>ACAA</u>-5'<br>Target: 5'-AGCCCGAACTGCAAGTTGCTTATTGTT-3' | (SEQ ID NO: 1600)<br>(SEQ ID NO: 3614)<br>(SEQ ID NO: 5628) |
| LDHA-681 | 5'-<u>CC</u>GAACUGCAAGUU<u>GC</u>UUAUUGUtt-3'<br>3'-<u>C</u>GGGCUUGACGUUC<u>AA</u>CGAAUAAC<u>AAA</u>-5'<br>Target: 5'-GCCCGAACTGCAAGTTGCTTATTGTTT-3' | (SEQ ID NO: 1601)<br>(SEQ ID NO: 3615)<br>(SEQ ID NO: 5629) |
| LDHA-682 | 5'-<u>C</u>G<u>A</u>ACUGCAAGUUG<u>C</u>UUAUUGUUtc-3'<br>3'-<u>GGG</u>CUUGACGUUCA<u>C</u>GAAUAACA<u>AAG</u>-5'<br>Target: 5'-CCCGAACTGCAAGTTGCTTATTGTTTC-3' | (SEQ ID NO: 1602)<br>(SEQ ID NO: 3616)<br>(SEQ ID NO: 5630) |
| LDHA-683 | 5'-G<u>A</u>ACUGCAAGUUGC<u>UU</u>AUUGUUUca-3'<br>3'-<u>GG</u>CUUGACGUUCAA<u>C</u>GAAUAACA<u>AAGU</u>-5'<br>Target: 5'-CCGAACTGCAAGTTGCTTATTGTTTCA-3' | (SEQ ID NO: 1603)<br>(SEQ ID NO: 3617)<br>(SEQ ID NO: 5631) |
| LDHA-684 | 5'-<u>A</u>ACUGCAAGUUGC<u>UU</u>AUUGUUUCaa-3'<br>3'-<u>GC</u>UUGACGUUCAAC<u>G</u>AAUAACAAA<u>GUU</u>-5'<br>Target: 5'-CGAACTGCAAGTTGCTTATTGTTTCAA-3' | (SEQ ID NO: 1604)<br>(SEQ ID NO: 3618)<br>(SEQ ID NO: 5632) |
| LDHA-685 | 5'-<u>AC</u>UGCAAGUUGCU<u>UA</u>UUGUUUCAaa-3'<br>3'-<u>C</u>UUGACGUUCAACGAAUAACAAA<u>GUU</u>-5'<br>Target: 5'-GAACTGCAAGTTGCTTATTGTTTCAAA-3' | (SEQ ID NO: 1605)<br>(SEQ ID NO: 3619)<br>(SEQ ID NO: 5633) |
| LDHA-686 | 5'-C<u>UGC</u>AAGUUGCUU<u>AUU</u>GUUUCAAat-3'<br>3'-<u>UU</u>GACGUUCAACGA<u>A</u>UAACAAAGU<u>UUA</u>-5'<br>Target: 5'-AACTGCAAGTTGCTTATTGTTTCAAAT-3' | (SEQ ID NO: 1606)<br>(SEQ ID NO: 3620)<br>(SEQ ID NO: 5634) |
| LDHA-687 | 5'-<u>UGC</u>AAGUUGCUUA<u>UU</u>GUUUCAAAtc-3'<br>3'-<u>UGA</u>CGUUCAACGAA<u>U</u>AACAAAGUU<u>UAG</u>-5'<br>Target: 5'-ACTGCAAGTTGCTTATTGTTTCAAATC-3' | (SEQ ID NO: 1607)<br>(SEQ ID NO: 3621)<br>(SEQ ID NO: 5635) |
| LDHA-688 | 5'-<u>GC</u>AAGUUGCUUAU<u>UG</u>UUUCAAAUcc-3'<br>3'-<u>GAC</u>GUUCAACGAAU<u>AA</u>CAAAGUUU<u>AGG</u>-5'<br>Target: 5'-CTGCAAGTTGCTTATTGTTTCAAATCC-3' | (SEQ ID NO: 1608)<br>(SEQ ID NO: 3622)<br>(SEQ ID NO: 5636) |
| LDHA-689 | 5'-C<u>A</u>AGUUGCUUAUU<u>G</u>UUUCAAAUCca-3'<br>3'-<u>AC</u>GUUCAACGAAUA<u>AC</u>AAAGUUUA<u>GGU</u>-5'<br>Target: 5'-TGCAAGTTGCTTATTGTTTCAAATCCA-3' | (SEQ ID NO: 1609)<br>(SEQ ID NO: 3623)<br>(SEQ ID NO: 5637) |
| LDHA-690 | 5'-<u>A</u>AGUUGCUUAUUG<u>UUU</u>CAAAUCCag-3'<br>3'-<u>C</u>GUUCAACGAAUAACAAAGUUUAG<u>GUC</u>-5'<br>Target: 5'-GCAAGTTGCTTATTGTTTCAAATCCAG-3' | (SEQ ID NO: 1610)<br>(SEQ ID NO: 3624)<br>(SEQ ID NO: 5638) |
| LDHA-691 | 5'-<u>A</u>GUUGCUUAUUGU<u>UU</u>CAAAUCCAgt-3'<br>3'-<u>GUU</u>CAACGAAUAACA<u>A</u>AGUUUAGG<u>UCA</u>-5'<br>Target: 5'-CAAGTTGCTTATTGTTTCAAATCCAGT-3' | (SEQ ID NO: 1611)<br>(SEQ ID NO: 3625)<br>(SEQ ID NO: 5639) |
| LDHA-692 | 5'-G<u>UUG</u>CUUAUUGUU<u>U</u>CAAAUCCAGtg-3'<br>3'-<u>UUCA</u>ACGAAUAACA<u>AA</u>GUUUAGGU<u>CAC</u>-5'<br>Target: 5'-AAGTTGCTTATTGTTTCAAATCCAGTG-3' | (SEQ ID NO: 1612)<br>(SEQ ID NO: 3626)<br>(SEQ ID NO: 5640) |

TABLE 12-continued

Additional Selected Human Anti-Lactate Dehydrogenase DsiRNA Agents (Asymmetrics)

| | | |
|---|---|---|
| LDHA-693 Target: | 5'-UUGCUUAUUGUUUCAAAUCCAGUGgg-3'<br>3'-UCAACGAAUAACAAAGUUUAGGUCACC-5'<br>5'-AGTTGCTTATTGTTTCAAATCCAGTGG-3' | (SEQ ID NO: 1613)<br>(SEQ ID NO: 3627)<br>(SEQ ID NO: 5641) |
| LDHA-694 Target: | 5'-UGCUUAUUGUUUCAAAUCCAGUGga-3'<br>3'-CAACGAAUAACAAAGUUUAGGUCACCU-5'<br>5'-GTTGCTTATTGTTTCAAATCCAGTGGA-3' | (SEQ ID NO: 1614)<br>(SEQ ID NO: 3628)<br>(SEQ ID NO: 5642) |
| LDHA-695 Target: | 5'-GCUUAUUGUUUCAAAUCCAGUGGat-3'<br>3'-AACGAAUAACAAAGUUUAGGUCACCUA-5'<br>5'-TTGCTTATTGTTTCAAATCCAGTGGAT-3' | (SEQ ID NO: 1615)<br>(SEQ ID NO: 3629)<br>(SEQ ID NO: 5643) |
| LDHA-696 Target: | 5'-CUUAUUGUUUCAAAUCCAGUGGAta-3'<br>3'-ACGAAUAACAAAGUUUAGGUCACCUAU-5'<br>5'-TGCTTATTGTTTCAAATCCAGTGGATA-3' | (SEQ ID NO: 1616)<br>(SEQ ID NO: 3630)<br>(SEQ ID NO: 5644) |
| LDHA-697 Target: | 5'-UUAUUGUUUCAAAUCCAGUGGAUat-3'<br>3'-CGAAUAACAAAGUUUAGGUCACCUAUA-5'<br>5'-GCTTATTGTTTCAAATCCAGTGGATAT-3' | (SEQ ID NO: 1617)<br>(SEQ ID NO: 3631)<br>(SEQ ID NO: 5645) |
| LDHA-698 Target: | 5'-UAUUGUUUCAAAUCCAGUGGAUAtc-3'<br>3'-GAAUAACAAAGUUUAGGUCACCUAUAG-5'<br>5'-CTTATTGTTTCAAATCCAGTGGATATC-3' | (SEQ ID NO: 1618)<br>(SEQ ID NO: 3632)<br>(SEQ ID NO: 5646) |
| LDHA-699 Target: | 5'-AUUGUUUCAAAUCCAGUGGAUAUct-3'<br>3'-AAUAACAAAGUUUAGGUCACCUAUAGA-5'<br>5'-TTATTGTTTCAAATCCAGTGGATATCT-3' | (SEQ ID NO: 1619)<br>(SEQ ID NO: 3633)<br>(SEQ ID NO: 5647) |
| LDHA-700 Target: | 5'-UUGUUUCAAAUCCAGUGGAUAUCtt-3'<br>3'-AUAACAAAGUUUAGGUCACCUAUAGAA-5'<br>5'-TATTGTTTCAAATCCAGTGGATATCTT-3' | (SEQ ID NO: 1620)<br>(SEQ ID NO: 3634)<br>(SEQ ID NO: 5648) |
| LDHA-701 Target: | 5'-UGUUUCAAAUCCAGUGGAUAUCUtg-3'<br>3'-UAACAAAGUUUAGGUCACCUAUAGAAC-5'<br>5'-ATTGTTTCAAATCCAGTGGATATCTTG-3' | (SEQ ID NO: 1621)<br>(SEQ ID NO: 3635)<br>(SEQ ID NO: 5649) |
| LDHA-702 Target: | 5'-GUUUCAAAUCCAGUGGAUAUCUUga-3'<br>3'-AACAAAGUUUAGGUCACCUAUAGAACU-5'<br>5'-TTGTTTCAAATCCAGTGGATATCTTGA-3' | (SEQ ID NO: 1622)<br>(SEQ ID NO: 3636)<br>(SEQ ID NO: 5650) |
| LDHA-703 Target: | 5'-UUUCAAAUCCAGUGGAUAUCUUGac-3'<br>3'-ACAAAGUUUAGGUCACCUAUAGAACUG-5'<br>5'-TGTTTCAAATCCAGTGGATATCTTGAC-3' | (SEQ ID NO: 1623)<br>(SEQ ID NO: 3637)<br>(SEQ ID NO: 5651) |
| LDHA-704 Target: | 5'-UUCAAAUCCAGUGGAUAUCUUGAcc-3'<br>3'-CAAAGUUUAGGUCACCUAUAGAACUGG-5'<br>5'-GTTTCAAATCCAGTGGATATCTTGACC-3' | (SEQ ID NO: 1624)<br>(SEQ ID NO: 3638)<br>(SEQ ID NO: 5652) |
| LDHA-705 Target: | 5'-UCAAAUCCAGUGGAUAUCUUGACct-3'<br>3'-AAAGUUUAGGUCACCUAUAGAACUGGA-5'<br>5'-TTTCAAATCCAGTGGATATCTTGACCT-3' | (SEQ ID NO: 1625)<br>(SEQ ID NO: 3639)<br>(SEQ ID NO: 5653) |
| LDHA-706 Target: | 5'-CAAAUCCAGUGGAUAUCUUGACCta-3'<br>3'-AAGUUUAGGUCACCUAUAGAACUGGAU-5'<br>5'-TTCAAATCCAGTGGATATCTTGACCTA-3' | (SEQ ID NO: 1626)<br>(SEQ ID NO: 3640)<br>(SEQ ID NO: 5654) |
| LDHA-707 Target: | 5'-AAAUCCAGUGGAUAUCUUGACCUac-3'<br>3'-AGUUUAGGUCACCUAUAGAACUGGAUG-5'<br>5'-TCAAATCCAGTGGATATCTTGACCTAC-3' | (SEQ ID NO: 1627)<br>(SEQ ID NO: 3641)<br>(SEQ ID NO: 5655) |
| LDHA-708 Target: | 5'-AAUCCAGUGGAUAUCUUGACCUAcg-3'<br>3'-GUUUAGGUCACCUAUAGAACUGGAUGC-5'<br>5'-CAAATCCAGTGGATATCTTGACCTACG-3' | (SEQ ID NO: 1628)<br>(SEQ ID NO: 3642)<br>(SEQ ID NO: 5656) |
| LDHA-709 Target: | 5'-AUCCAGUGGAUAUCUUGACCUACgt-3'<br>3'-UUUAGGUCACCUAUAGAACUGGAUGCA-5'<br>5'-AAATCCAGTGGATATCTTGACCTACGT-3' | (SEQ ID NO: 1629)<br>(SEQ ID NO: 3643)<br>(SEQ ID NO: 5657) |
| LDHA-710 Target: | 5'-UCCAGUGGAUAUCUUGACCUACGtg-3'<br>3'-UUAGGUCACCUAUAGAACUGGAUGCAC-5'<br>5'-AATCCAGTGGATATCTTGACCTACGTG-3' | (SEQ ID NO: 1630)<br>(SEQ ID NO: 3644)<br>(SEQ ID NO: 5658) |
| LDHA-711 Target: | 5'-CCAGUGGAUAUCUUGACCUACGUgg-3'<br>3'-UAGGUCACCUAUAGAACUGGAUGCACC-5'<br>5'-ATCCAGTGGATATCTTGACCTACGTGG-3' | (SEQ ID NO: 1631)<br>(SEQ ID NO: 3645)<br>(SEQ ID NO: 5659) |

TABLE 12-continued

Additional Selected Human Anti-Lactate Dehydrogenase DsiRNA Agents (Asymmetrics)

| | | |
|---|---|---|
| LDHA-712 | 5'-CAGUGGAUAUCUUGACCUACGUGGgc-3'<br>3'-AGGUCACCUAUAGAACUGGAUGCACCG-5'<br>Target: 5'-TCCAGTGGATATCTTGACCTACGTGGC-3' | (SEQ ID NO: 1632)<br>(SEQ ID NO: 3646)<br>(SEQ ID NO: 5660) |
| LDHA-713 | 5'-AGUGGAUAUCUUGACCUACGUGGct-3'<br>3'-GGUCACCUAUAGAACUGGAUGCACCGA-5'<br>Target: 5'-CCAGTGGATATCTTGACCTACGTGGCT-3' | (SEQ ID NO: 1633)<br>(SEQ ID NO: 3647)<br>(SEQ ID NO: 5661) |
| LDHA-715 | 5'-UGGAUAUCUUGACCUACGUGGCUtg-3'<br>3'-UCACCUAUAGAACUGGAUGCACCGAAC-5'<br>Target: 5'-AGTGGATATCTTGACCTACGTGGCTTG-3' | (SEQ ID NO: 1634)<br>(SEQ ID NO: 3648)<br>(SEQ ID NO: 5662) |
| LDHA-716 | 5'-GGAUAUCUUGACCUACGUGGCUUgg-3'<br>3'-CACCUAUAGAACUGGAUGCACCGAACC-5'<br>Target: 5'-GTGGATATCTTGACCTACGTGGCTTGG-3' | (SEQ ID NO: 1635)<br>(SEQ ID NO: 3649)<br>(SEQ ID NO: 5663) |
| LDHA-721 | 5'-UCUUGACCUACGUGGCUUGGAAGat-3'<br>3'-AUAGAACUGGAUGCACCGAACCUUCUA-5'<br>Target: 5'-TATCTTGACCTACGTGGCTTGGAAGAT-3' | (SEQ ID NO: 1636)<br>(SEQ ID NO: 3650)<br>(SEQ ID NO: 5664) |
| LDHA-725 | 5'-GACCUACGUGGCUUGGAAGAUAAgt-3'<br>3'-AACUGGAUGCACCGAACCUUCUAUUCA-5'<br>Target: 5'-TTGACCTACGTGGCTTGGAAGATAAGT-3' | (SEQ ID NO: 1637)<br>(SEQ ID NO: 3651)<br>(SEQ ID NO: 5665) |
| LDHA-726 | 5'-ACCUACGUGGCUUGGAAGAUAAGtg-3'<br>3'-ACUGGAUGCACCGAACCUUCUAUUCAC-5'<br>Target: 5'-TGACCTACGTGGCTTGGAAGATAAGTG-3' | (SEQ ID NO: 1638)<br>(SEQ ID NO: 3652)<br>(SEQ ID NO: 5666) |
| LDHA-727 | 5'-CCUACGUGGCUUGGAAGAUAAGUgg-3'<br>3'-CUGGAUGCACCGAACCUUCUAUUCACC-5'<br>Target: 5'-GACCTACGTGGCTTGGAAGATAAGTGG-3' | (SEQ ID NO: 1639)<br>(SEQ ID NO: 3653)<br>(SEQ ID NO: 5667) |
| LDHA-728 | 5'-CUACGUGGCUUGGAAGAUAAGUGgt-3'<br>3'-UGGAUGCACCGAACCUUCUAUUCACCA-5'<br>Target: 5'-ACCTACGTGGCTTGGAAGATAAGTGGT-3' | (SEQ ID NO: 1640)<br>(SEQ ID NO: 3654)<br>(SEQ ID NO: 5668) |
| LDHA-729 | 5'-UACGUGGCUUGGAAGAUAAGUGGtt-3'<br>3'-GGAUGCACCGAACCUUCUAUUCACCAA-5'<br>Target: 5'-CCTACGTGGCTTGGAAGATAAGTGGTT-3' | (SEQ ID NO: 1641)<br>(SEQ ID NO: 3655)<br>(SEQ ID NO: 5669) |
| LDHA-730 | 5'-ACGUGGCUUGGAAGAUAAGUGGUtt-3'<br>3'-GAUGCACCGAACCUUCUAUUCACCAAA-5'<br>Target: 5'-CTACGTGGCTTGGAAGATAAGTGGTTT-3' | (SEQ ID NO: 1642)<br>(SEQ ID NO: 3656)<br>(SEQ ID NO: 5670) |
| LDHA-731 | 5'-CGUGGCUUGGAAGAUAAGUGGUUtt-3'<br>3'-AUGCACCGAACCUUCUAUUCACCAAAA-5'<br>Target: 5'-TACGTGGCTTGGAAGATAAGTGGTTTT-3' | (SEQ ID NO: 1643)<br>(SEQ ID NO: 3657)<br>(SEQ ID NO: 5671) |
| LDHA-732 | 5'-GUGGCUUGGAAGAUAAGUGGUUUtc-3'<br>3'-UGCACCGAACCUUCUAUUCACCAAAAG-5'<br>Target: 5'-ACGTGGCTTGGAAGATAAGTGGTTTTC-3' | (SEQ ID NO: 1644)<br>(SEQ ID NO: 3658)<br>(SEQ ID NO: 5672) |
| LDHA-733 | 5'-UGGCUUGGAAGAUAAGUGGUUUUcc-3'<br>3'-GCACCGAACCUUCUAUUCACCAAAAGG-5'<br>Target: 5'-CGTGGCTTGGAAGATAAGTGGTTTTCC-3' | (SEQ ID NO: 1645)<br>(SEQ ID NO: 3659)<br>(SEQ ID NO: 5673) |
| LDHA-734 | 5'-GGCUUGGAAGAUAAGUGGUUUUCcc-3'<br>3'-CACCGAACCUUCUAUUCACCAAAAGGG-5'<br>Target: 5'-GTGGCTTGGAAGATAAGTGGTTTTCCC-3' | (SEQ ID NO: 1646)<br>(SEQ ID NO: 3660)<br>(SEQ ID NO: 5674) |
| LDHA-735 | 5'-GCUUGGAAGAUAAGUGGUUUUCCca-3'<br>3'-ACCGAACCUUCUAUUCACCAAAAGGGU-5'<br>Target: 5'-TGGCTTGGAAGATAAGTGGTTTTCCCA-3' | (SEQ ID NO: 1647)<br>(SEQ ID NO: 3661)<br>(SEQ ID NO: 5675) |
| LDHA-736 | 5'-CUUGGAAGAUAAGUGGUUUUCCCaa-3'<br>3'-CCGAACCUUCUAUUCACCAAAAGGGUU-5'<br>Target: 5'-GGCTTGGAAGATAAGTGGTTTTCCCAA-3' | (SEQ ID NO: 1648)<br>(SEQ ID NO: 3662)<br>(SEQ ID NO: 5676) |
| LDHA-737 | 5'-UUGGAAGAUAAGUGGUUUUCCCAaa-3'<br>3'-CGAACCUUCUAUUCACCAAAAGGGUUU-5'<br>Target: 5'-GCTTGGAAGATAAGTGGTTTTCCCAAA-3' | (SEQ ID NO: 1649)<br>(SEQ ID NO: 3663)<br>(SEQ ID NO: 5677) |
| LDHA-738 | 5'-UGGAAGAUAAGUGGUUUUCCCAAaa-3'<br>3'-GAACCUUCUAUUCACCAAAAGGGUUUU-5'<br>Target: 5'-CTTGGAAGATAAGTGGTTTTCCCAAAA-3' | (SEQ ID NO: 1650)<br>(SEQ ID NO: 3664)<br>(SEQ ID NO: 5678) |

TABLE 12-continued

Additional Selected Human Anti-Lactate Dehydrogenase DsiRNA Agents (Asymmetrics)

| | | |
|---|---|---|
| LDHA-741 Target: | 5'-AAGAUAAGUGGUUUUCCCAAAAAcc-3'<br>3'-CCUUCUAUUCACCAAAAGGGUUUUUGG-5'<br>5'-GGAAGATAAGTGGTTTTCCCAAAAACC-3' | (SEQ ID NO: 1651)<br>(SEQ ID NO: 3665)<br>(SEQ ID NO: 5679) |
| LDHA-742 Target: | 5'-AGAUAAGUGGUUUUCCCAAAAACcg-3'<br>3'-CUUCUAUUCACCAAAAGGGUUUUUGGC-5'<br>5'-GAAGATAAGTGGTTTTCCCAAAAACCG-3' | (SEQ ID NO: 1652)<br>(SEQ ID NO: 3666)<br>(SEQ ID NO: 5680) |
| LDHA-743 Target: | 5'-GAUAAGUGGUUUUCCCAAAAACCgt-3'<br>3'-UUCUAUUCACCAAAAGGGUUUUUGGCA-5'<br>5'-AAGATAAGTGGTTTTCCCAAAAACCGT-3' | (SEQ ID NO: 1653)<br>(SEQ ID NO: 3667)<br>(SEQ ID NO: 5681) |
| LDHA-744 Target: | 5'-AUAAGUGGUUUUCCCAAAAACCGtg-3'<br>3'-UCUAUUCACCAAAAGGGUUUUUGGCAC-5'<br>5'-AGATAAGTGGTTTTCCCAAAAACCGTG-3' | (SEQ ID NO: 1654)<br>(SEQ ID NO: 3668)<br>(SEQ ID NO: 5682) |
| LDHA-745 Target: | 5'-UAAGUGGUUUUCCCAAAAACCGUgt-3'<br>3'-CUAUUCACCAAAAGGGUUUUUGGCACA-5'<br>5'-GATAAGTGGTTTTCCCAAAAACCGTGT-3' | (SEQ ID NO: 1655)<br>(SEQ ID NO: 3669)<br>(SEQ ID NO: 5683) |
| LDHA-746 Target: | 5'-AAGUGGUUUUCCCAAAAACCGUGtt-3'<br>3'-UAUUCACCAAAAGGGUUUUUGGCACAA-5'<br>5'-ATAAGTGGTTTTCCCAAAAACCGTGTT-3' | (SEQ ID NO: 1656)<br>(SEQ ID NO: 3670)<br>(SEQ ID NO: 5684) |
| LDHA-747 Target: | 5'-AGUGGUUUUCCCAAAAACCGUGUta-3'<br>3'-AUUCACCAAAAGGGUUUUUGGCACAAU-5'<br>5'-TAAGTGGTTTTCCCAAAAACCGTGTTA-3' | (SEQ ID NO: 1657)<br>(SEQ ID NO: 3671)<br>(SEQ ID NO: 5685) |
| LDHA-748 Target: | 5'-GUGGUUUUCCCAAAAACCGUGUUat-3'<br>3'-UUCACCAAAAGGGUUUUUGGCACAAUA-5'<br>5'-AAGTGGTTTTCCCAAAAACCGTGTTAT-3' | (SEQ ID NO: 1658)<br>(SEQ ID NO: 3672)<br>(SEQ ID NO: 5686) |
| LDHA-749 Target: | 5'-UGGUUUUCCCAAAAACCGUGUUAtt-3'<br>3'-UCACCAAAAGGGUUUUUGGCACAAUAA-5'<br>5'-AGTGGTTTTCCCAAAAACCGTGTTATT-3' | (SEQ ID NO: 1659)<br>(SEQ ID NO: 3673)<br>(SEQ ID NO: 5687) |
| LDHA-750 Target: | 5'-GGUUUUCCCAAAAACCGUGUUAUtg-3'<br>3'-CACCAAAAGGGUUUUUGGCACAAUAAC-5'<br>5'-GTGGTTTTCCCAAAAACCGTGTTATTG-3' | (SEQ ID NO: 1660)<br>(SEQ ID NO: 3674)<br>(SEQ ID NO: 5688) |
| LDHA-751 Target: | 5'-GUUUUCCCAAAAACCGUGUUAUUgg-3'<br>3'-ACCAAAAGGGUUUUUGGCACAAUAACC-5'<br>5'-TGGTTTTCCCAAAAACCGTGTTATTGG-3' | (SEQ ID NO: 1661)<br>(SEQ ID NO: 3675)<br>(SEQ ID NO: 5689) |
| LDHA-752 Target: | 5'-UUUUCCCAAAAACCGUGUUAUUGga-3'<br>3'-CCAAAAGGGUUUUUGGCACAAUAACCU-5'<br>5'-GGTTTTCCCAAAAACCGTGTTATTGGA-3' | (SEQ ID NO: 1662)<br>(SEQ ID NO: 3676)<br>(SEQ ID NO: 5690) |
| LDHA-753 Target: | 5'-UUUCCCAAAAACCGUGUUAUUGGaa-3'<br>3'-CAAAAGGGUUUUUGGCACAAUAACCUU-5'<br>5'-GTTTTCCCAAAAACCGTGTTATTGGAA-3' | (SEQ ID NO: 1663)<br>(SEQ ID NO: 3677)<br>(SEQ ID NO: 5691) |
| LDHA-754 Target: | 5'-UUCCCAAAAACCGUGUUAUUGGAag-3'<br>3'-AAAAGGGUUUUUGGCACAAUAACCUUC-5'<br>5'-TTTTCCCAAAAACCGTGTTATTGGAAG-3' | (SEQ ID NO: 1664)<br>(SEQ ID NO: 3678)<br>(SEQ ID NO: 5692) |
| LDHA-755 Target: | 5'-UCCCAAAAACCGUGUUAUUGGAAgc-3'<br>3'-AAAGGGUUUUUGGCACAAUAACCUUCG-5'<br>5'-TTTCCCAAAAACCGTGTTATTGGAAGC-3' | (SEQ ID NO: 1665)<br>(SEQ ID NO: 3679)<br>(SEQ ID NO: 5693) |
| LDHA-756 Target: | 5'-CCCAAAAACCGUGUUAUUGGAAGcg-3'<br>3'-AAGGGUUUUUGGCACAAUAACCUUCGC-5'<br>5'-TTCCCAAAAACCGTGTTATTGGAAGCG-3' | (SEQ ID NO: 1666)<br>(SEQ ID NO: 3680)<br>(SEQ ID NO: 5694) |
| LDHA-757 Target: | 5'-CCAAAAACCGUGUUAUUGGAAGCgg-3'<br>3'-AGGGUUUUUGGCACAAUAACCUUCGCC-5'<br>5'-TCCCAAAAACCGTGTTATTGGAAGCGG-3' | (SEQ ID NO: 1667)<br>(SEQ ID NO: 3681)<br>(SEQ ID NO: 5695) |
| LDHA-758 Target: | 5'-CAAAAACCGUGUUAUUGGAAGCGgt-3'<br>3'-GGGUUUUUGGCACAAUAACCUUCGCCA-5'<br>5'-CCCAAAAACCGTGTTATTGGAAGCGGT-3' | (SEQ ID NO: 1668)<br>(SEQ ID NO: 3682)<br>(SEQ ID NO: 5696) |
| LDHA-759 Target: | 5'-AAAAACCGUGUUAUUGGAAGCGGtt-3'<br>3'-GGUUUUUGGCACAAUAACCUUCGCCAA-5'<br>5'-CCAAAAACCGTGTTATTGGAAGCGGTT-3' | (SEQ ID NO: 1669)<br>(SEQ ID NO: 3683)<br>(SEQ ID NO: 5697) |

TABLE 12-continued

Additional Selected Human Anti-Lactate Dehydrogenase DsiRNA Agents (Asymmetrics)

| | | |
|---|---|---|
| | 5'-AAAACCGUGUUAUUGGAAGCGGUtg-3' | (SEQ ID NO: 1670) |
| | 3'-GUUUUUGGCACAAUAACCUUCGCCAAC-5' | (SEQ ID NO: 3684) |
| LDHA-760 Target: | 5'-CAAAAACCGTGTTATTGGAAGCGGTTG-3' | (SEQ ID NO: 5698) |
| | 5'-AAACCGUGUUAUUGGAAGCGGUUgc-3' | (SEQ ID NO: 1671) |
| | 3'-UUUUUGGCACAAUAACCUUCGCCAACG-5' | (SEQ ID NO: 3685) |
| LDHA-761 Target: | 5'-AAAAACCGTGTTATTGGAAGCGGTTGC-3' | (SEQ ID NO: 5699) |
| | 5'-AACCGUGUUAUUGGAAGCGGUUGca-3' | (SEQ ID NO: 1672) |
| | 3'-UUUUGGCACAAUAACCUUCGCCAACGU-5' | (SEQ ID NO: 3686) |
| LDHA-762 Target: | 5'-AAAACCGTGTTATTGGAAGCGGTTGCA-3' | (SEQ ID NO: 5700) |
| | 5'-ACCGUGUUAUUGGAAGCGGUUGCaa-3' | (SEQ ID NO: 1673) |
| | 3'-UUUGGCACAAUAACCUUCGCCAACGUU-5' | (SEQ ID NO: 3687) |
| LDHA-763 Target: | 5'-AAACCGTGTTATTGGAAGCGGTTGCAA-3' | (SEQ ID NO: 5701) |
| | 5'-CCGUGUUAUUGGAAGCGGUUGCAat-3' | (SEQ ID NO: 1674) |
| | 3'-UUGGCACAAUAACCUUCGCCAACGUUA-5' | (SEQ ID NO: 3688) |
| LDHA-764 Target: | 5'-AACCGTGTTATTGGAAGCGGTTGCAAT-3' | (SEQ ID NO: 5702) |
| | 5'-CGUGUUAUUGGAAGCGGUUGCAAtc-3' | (SEQ ID NO: 1675) |
| | 3'-UGGCACAAUAACCUUCGCCAACGUUAG-5' | (SEQ ID NO: 3689) |
| LDHA-765 Target: | 5'-ACCGTGTTATTGGAAGCGGTTGCAATC-3' | (SEQ ID NO: 5703) |
| | 5'-GUGUUAUUGGAAGCGGUUGCAAUct-3' | (SEQ ID NO: 1676) |
| | 3'-GGCACAAUAACCUUCGCCAACGUUAGA-5' | (SEQ ID NO: 3690) |
| LDHA-766 Target: | 5'-CCGTGTTATTGGAAGCGGTTGCAATCT-3' | (SEQ ID NO: 5704) |
| | 5'-UGUUAUUGGAAGCGGUUGCAAUCtg-3' | (SEQ ID NO: 1677) |
| | 3'-GCACAAUAACCUUCGCCAACGUUAGAC-5' | (SEQ ID NO: 3691) |
| LDHA-767 Target: | 5'-CGTGTTATTGGAAGCGGTTGCAATCTG-3' | (SEQ ID NO: 5705) |
| | 5'-GUUAUUGGAAGCGGUUGCAAUCUgg-3' | (SEQ ID NO: 1678) |
| | 3'-CACAAUAACCUUCGCCAACGUUAGACC-5' | (SEQ ID NO: 3692) |
| LDHA-768 Target: | 5'-GTGTTATTGGAAGCGGTTGCAATCTGG-3' | (SEQ ID NO: 5706) |
| | 5'-UUAUUGGAAGCGGUUGCAAUCUGga-3' | (SEQ ID NO: 1679) |
| | 3'-ACAAUAACCUUCGCCAACGUUAGACCU-5' | (SEQ ID NO: 3693) |
| LDHA-769 Target: | 5'-TGTTATTGGAAGCGGTTGCAATCTGGA-3' | (SEQ ID NO: 5707) |
| | 5'-UAUUGGAAGCGGUUGCAAUCUGGat-3' | (SEQ ID NO: 1680) |
| | 3'-CAAUAACCUUCGCCAACGUUAGACCUA-5' | (SEQ ID NO: 3694) |
| LDHA-770 Target: | 5'-GTTATTGGAAGCGGTTGCAATCTGGAT-3' | (SEQ ID NO: 5708) |
| | 5'-AUUGGAAGCGGUUGCAAUCUGGAtt-3' | (SEQ ID NO: 1681) |
| | 3'-AAUAACCUUCGCCAACGUUAGACCUAA-5' | (SEQ ID NO: 3695) |
| LDHA-771 Target: | 5'-TTATTGGAAGCGGTTGCAATCTGGATT-3' | (SEQ ID NO: 5709) |
| | 5'-UUGGAAGCGGUUGCAAUCUGGAUtc-3' | (SEQ ID NO: 1682) |
| | 3'-AUAACCUUCGCCAACGUUAGACCUAAG-5' | (SEQ ID NO: 3696) |
| LDHA-772 Target: | 5'-TATTGGAAGCGGTTGCAATCTGGATTC-3' | (SEQ ID NO: 5710) |
| | 5'-UGGAAGCGGUUGCAAUCUGGAUUca-3' | (SEQ ID NO: 1683) |
| | 3'-UAACCUUCGCCAACGUUAGACCUAAGU-5' | (SEQ ID NO: 3697) |
| LDHA-773 Target: | 5'-ATTGGAAGCGGTTGCAATCTGGATTCA-3' | (SEQ ID NO: 5711) |
| | 5'-GGAAGCGGUUGCAAUCUGGAUUCag-3' | (SEQ ID NO: 1684) |
| | 3'-AACCUUCGCCAACGUUAGACCUAAGUC-5' | (SEQ ID NO: 3698) |
| LDHA-774 Target: | 5'-TTGGAAGCGGTTGCAATCTGGATTCAG-3' | (SEQ ID NO: 5712) |
| | 5'-GAAGCGGUUGCAAUCUGGAUUCAgc-3' | (SEQ ID NO: 1685) |
| | 3'-ACCUUCGCCAACGUUAGACCUAAGUCG-5' | (SEQ ID NO: 3699) |
| LDHA-775 Target: | 5'-TGGAAGCGGTTGCAATCTGGATTCAGC-3' | (SEQ ID NO: 5713) |
| | 5'-AAGCGGUUGCAAUCUGGAUUCAGcc-3' | (SEQ ID NO: 1686) |
| | 3'-CCUUCGCCAACGUUAGACCUAAGUCGG-5' | (SEQ ID NO: 3700) |
| LDHA-776 Target: | 5'-GGAAGCGGTTGCAATCTGGATTCAGCC-3' | (SEQ ID NO: 5714) |
| | 5'-AGCGGUUGCAAUCUGGAUUCAGCcc-3' | (SEQ ID NO: 1687) |
| | 3'-CUUCGCCAACGUUAGACCUAAGUCGGG-5' | (SEQ ID NO: 3701) |
| LDHA-777 Target: | 5'-GAAGCGGTTGCAATCTGGATTCAGCCC-3' | (SEQ ID NO: 5715) |
| | 5'-GCGGUUGCAAUCUGGAUUCAGCCcg-3' | (SEQ ID NO: 1688) |
| | 3'-UUCGCCAACGUUAGACCUAAGUCGGGC-5' | (SEQ ID NO: 3702) |
| LDHA-778 Target: | 5'-AAGCGGTTGCAATCTGGATTCAGCCCG-3' | (SEQ ID NO: 5716) |

TABLE 12-continued

Additional Selected Human Anti-Lactate Dehydrogenase DsiRNA Agents (Asymmetrics)

| | | |
|---|---|---|
| LDHA-779 Target: | 5'-CGGUUGCAAUCUGGAUUCAGCCCga-3'<br>3'-UCGCCAACGUUAGACCUAAGUCGGGCU-5'<br>5'-AGCGGTTGCAATCTGGATTCAGCCCGA-3' | (SEQ ID NO: 1689)<br>(SEQ ID NO: 3703)<br>(SEQ ID NO: 5717) |
| LDHA-780 Target: | 5'-GGUUGCAAUCUGGAUUCAGCCCGat-3'<br>3'-CGCCAACGUUAGACCUAAGUCGGGCUA-5'<br>5'-GCGGTTGCAATCTGGATTCAGCCCGAT-3' | (SEQ ID NO: 1690)<br>(SEQ ID NO: 3704)<br>(SEQ ID NO: 5718) |
| LDHA-781 Target: | 5'-GUUGCAAUCUGGAUUCAGCCCGAtt-3'<br>3'-GCCAACGUUAGACCUAAGUCGGGCUAA-5'<br>5'-CGGTTGCAATCTGGATTCAGCCCGATT-3' | (SEQ ID NO: 1691)<br>(SEQ ID NO: 3705)<br>(SEQ ID NO: 5719) |
| LDHA-782 Target: | 5'-UUGCAAUCUGGAUUCAGCCCGAUtc-3'<br>3'-CCAACGUUAGACCUAAGUCGGGCUAAG-5'<br>5'-GGTTGCAATCTGGATTCAGCCCGATTC-3' | (SEQ ID NO: 1692)<br>(SEQ ID NO: 3706)<br>(SEQ ID NO: 5720) |
| LDHA-783 Target: | 5'-UGCAAUCUGGAUUCAGCCCGAUUcc-3'<br>3'-CAACGUUAGACCUAAGUCGGGCUAAGG-5'<br>5'-GTTGCAATCTGGATTCAGCCCGATTCC-3' | (SEQ ID NO: 1693)<br>(SEQ ID NO: 3707)<br>(SEQ ID NO: 5721) |
| LDHA-784 Target: | 5'-GCAAUCUGGAUUCAGCCCGAUUCcg-3'<br>3'-AACGUUAGACCUAAGUCGGGCUAAGGC-5'<br>5'-TTGCAATCTGGATTCAGCCCGATTCCG-3' | (SEQ ID NO: 1694)<br>(SEQ ID NO: 3708)<br>(SEQ ID NO: 5722) |
| LDHA-785 Target: | 5'-CAAUCUGGAUUCAGCCCGAUUCCgt-3'<br>3'-ACGUUAGACCUAAGUCGGGCUAAGGCA-5'<br>5'-TGCAATCTGGATTCAGCCCGATTCCGT-3' | (SEQ ID NO: 1695)<br>(SEQ ID NO: 3709)<br>(SEQ ID NO: 5723) |
| LDHA-786 Target: | 5'-AAUCUGGAUUCAGCCCGAUUCCGtt-3'<br>3'-CGUUAGACCUAAGUCGGGCUAAGGCAA-5'<br>5'-GCAATCTGGATTCAGCCCGATTCCGTT-3' | (SEQ ID NO: 1696)<br>(SEQ ID NO: 3710)<br>(SEQ ID NO: 5724) |
| LDHA-787 Target: | 5'-AUCUGGAUUCAGCCCGAUUCCGUta-3'<br>3'-GUUAGACCUAAGUCGGGCUAAGGCAAU-5'<br>5'-CAATCTGGATTCAGCCCGATTCCGTTA-3' | (SEQ ID NO: 1697)<br>(SEQ ID NO: 3711)<br>(SEQ ID NO: 5725) |
| LDHA-788 Target: | 5'-UCUGGAUUCAGCCCGAUUCCGUUac-3'<br>3'-UUAGACCUAAGUCGGGCUAAGGCAAUG-5'<br>5'-AATCTGGATTCAGCCCGATTCCGTTAC-3' | (SEQ ID NO: 1698)<br>(SEQ ID NO: 3712)<br>(SEQ ID NO: 5726) |
| LDHA-789 Target: | 5'-CUGGAUUCAGCCCGAUUCCGUUAcc-3'<br>3'-UAGACCUAAGUCGGGCUAAGGCAAUGG-5'<br>5'-ATCTGGATTCAGCCCGATTCCGTTACC-3' | (SEQ ID NO: 1699)<br>(SEQ ID NO: 3713)<br>(SEQ ID NO: 5727) |
| LDHA-790 Target: | 5'-UGGAUUCAGCCCGAUUCCGUUACct-3'<br>3'-AGACCUAAGUCGGGCUAAGGCAAUGGA-5'<br>5'-TCTGGATTCAGCCCGATTCCGTTACCT-3' | (SEQ ID NO: 1700)<br>(SEQ ID NO: 3714)<br>(SEQ ID NO: 5728) |
| LDHA-791 Target: | 5'-GGAUUCAGCCCGAUUCCGUUACCta-3'<br>3'-GACCUAAGUCGGGCUAAGGCAAUGGAU-5'<br>5'-CTGGATTCAGCCCGATTCCGTTACCTA-3' | (SEQ ID NO: 1701)<br>(SEQ ID NO: 3715)<br>(SEQ ID NO: 5729) |
| LDHA-792 Target: | 5'-GAUUCAGCCCGAUUCCGUUACCUaa-3'<br>3'-ACCUAAGUCGGGCUAAGGCAAUGGAUU-5'<br>5'-TGGATTCAGCCCGATTCCGTTACCTAA-3' | (SEQ ID NO: 1702)<br>(SEQ ID NO: 3716)<br>(SEQ ID NO: 5730) |
| LDHA-793 Target: | 5'-AUUCAGCCCGAUUCCGUUACCUAat-3'<br>3'-CCUAAGUCGGGCUAAGGCAAUGGAUUA-5'<br>5'-GGATTCAGCCCGATTCCGTTACCTAAT-3' | (SEQ ID NO: 1703)<br>(SEQ ID NO: 3717)<br>(SEQ ID NO: 5731) |
| LDHA-794 Target: | 5'-UUCAGCCCGAUUCCGUUACCUAAtg-3'<br>3'-CUAAGUCGGGCUAAGGCAAUGGAUUAC-5'<br>5'-GATTCAGCCCGATTCCGTTACCTAATG-3' | (SEQ ID NO: 1704)<br>(SEQ ID NO: 3718)<br>(SEQ ID NO: 5732) |
| LDHA-795 Target: | 5'-UCAGCCCGAUUCCGUUACCUAAUgg-3'<br>3'-UAAGUCGGGCUAAGGCAAUGGAUUACC-5'<br>5'-ATTCAGCCCGATTCCGTTACCTAATGG-3' | (SEQ ID NO: 1705)<br>(SEQ ID NO: 3719)<br>(SEQ ID NO: 5733) |
| LDHA-796 Target: | 5'-CAGCCCGAUUCCGUUACCUAAUGgg-3'<br>3'-AAGUCGGGCUAAGGCAAUGGAUUACCC-5'<br>5'-TTCAGCCCGATTCCGTTACCTAATGGG-3' | (SEQ ID NO: 1706)<br>(SEQ ID NO: 3720)<br>(SEQ ID NO: 5734) |
| LDHA-797 Target: | 5'-AGCCCGAUUCCGUUACCUAAUGGg-3'<br>3'-AGUCGGGCUAAGGCAAUGGAUUACCCC-5'<br>5'-TCAGCCCGATTCCGTTACCTAATGGGG-3' | (SEQ ID NO: 1707)<br>(SEQ ID NO: 3721)<br>(SEQ ID NO: 5735) |

TABLE 12-continued

Additional Selected Human Anti-Lactate Dehydrogenase DsiRNA Agents (Asymmetrics)

|  |  |  |
| --- | --- | --- |
|  | 5'-GCCCGAUUCCGUUACCUAAUGGGgg-3' | (SEQ ID NO: 1708) |
|  | 3'-GUCGGGCUAAGGCAAUGGAUUACCCCC-5' | (SEQ ID NO: 3722) |
| LDHA-798 Target: | 5'-CAGCCCGATTCCGTTACCTAATGGGGG-3' | (SEQ ID NO: 5736) |
|  | 5'-CCCGAUUCCGUUACCUAAUGGGGga-3' | (SEQ ID NO: 1709) |
|  | 3'-UCGGGCUAAGGCAAUGGAUUACCCCCU-5' | (SEQ ID NO: 3723) |
| LDHA-799 Target: | 5'-AGCCCGATTCCGTTACCTAATGGGGGA-3' | (SEQ ID NO: 5737) |
|  | 5'-CCGAUUCCGUUACCUAAUGGGGaa-3' | (SEQ ID NO: 1710) |
|  | 3'-CGGGCUAAGGCAAUGGAUUACCCCCUU-5' | (SEQ ID NO: 3724) |
| LDHA-800 Target: | 5'-GCCCGATTCCGTTACCTAATGGGGGAA-3' | (SEQ ID NO: 5738) |
|  | 5'-CGAUUCCGUUACCUAAUGGGGGAaa-3' | (SEQ ID NO: 1711) |
|  | 3'-GGGCUAAGGCAAUGGAUUACCCCCUUU-5' | (SEQ ID NO: 3725) |
| LDHA-801 Target: | 5'-CCCGATTCCGTTACCTAATGGGGGAAA-3' | (SEQ ID NO: 5739) |
|  | 5'-GAUUCCGUUACCUAAUGGGGGAAag-3' | (SEQ ID NO: 1712) |
|  | 3'-GGCUAAGGCAAUGGAUUACCCCCUUUC-5' | (SEQ ID NO: 3726) |
| LDHA-802 Target: | 5'-CCGATTCCGTTACCTAATGGGGGAAAG-3' | (SEQ ID NO: 5740) |
|  | 5'-AUUCCGUUACCUAAUGGGGGAAAgg-3' | (SEQ ID NO: 1713) |
|  | 3'-GCUAAGGCAAUGGAUUACCCCCUUUCC-5' | (SEQ ID NO: 3727) |
| LDHA-803 Target: | 5'-CGATTCCGTTACCTAATGGGGGAAAGG-3' | (SEQ ID NO: 5741) |
|  | 5'-UUCCGUUACCUAAUGGGGGAAAGgc-3' | (SEQ ID NO: 1714) |
|  | 3'-CUAAGGCAAUGGAUUACCCCCUUUCCG-5' | (SEQ ID NO: 3728) |
| LDHA-804 Target: | 5'-GATTCCGTTACCTAATGGGGGAAAGGC-3' | (SEQ ID NO: 5742) |
|  | 5'-UCCGUUACCUAAUGGGGGAAAGGct-3' | (SEQ ID NO: 1715) |
|  | 3'-UAAGGCAAUGGAUUACCCCCUUUCCGA-5' | (SEQ ID NO: 3729) |
| LDHA-805 Target: | 5'-ATTCCGTTACCTAATGGGGGAAAGGCT-3' | (SEQ ID NO: 5743) |
|  | 5'-CCGUUACCUAAUGGGGGAAAGGCtg-3' | (SEQ ID NO: 1716) |
|  | 3'-AAGGCAAUGGAUUACCCCCUUUCCGAC-5' | (SEQ ID NO: 3730) |
| LDHA-806 Target: | 5'-TTCCGTTACCTAATGGGGGAAAGGCTG-3' | (SEQ ID NO: 5744) |
|  | 5'-CGUUACCUAAUGGGGGAAAGGCUgg-3' | (SEQ ID NO: 1717) |
|  | 3'-AGGCAAUGGAUUACCCCCUUUCCGACC-5' | (SEQ ID NO: 3731) |
| LDHA-807 Target: | 5'-TCCGTTACCTAATGGGGGAAAGGCTGG-3' | (SEQ ID NO: 5745) |
|  | 5'-GUUACCUAAUGGGGGAAAGGCUGgg-3' | (SEQ ID NO: 1718) |
|  | 3'-GGCAAUGGAUUACCCCCUUUCCGACCC-5' | (SEQ ID NO: 3732) |
| LDHA-808 Target: | 5'-CCGTTACCTAATGGGGGAAAGGCTGGG-3' | (SEQ ID NO: 5746) |
|  | 5'-UUACCUAAUGGGGGAAAGGCUGGga-3' | (SEQ ID NO: 1719) |
|  | 3'-GCAAUGGAUUACCCCCUUUCCGACCCU-5' | (SEQ ID NO: 3733) |
| LDHA-809 Target: | 5'-CGTTACCTAATGGGGGAAAGGCTGGGA-3' | (SEQ ID NO: 5747) |
|  | 5'-UACCUAAUGGGGGAAAGGCUGGGag-3' | (SEQ ID NO: 1720) |
|  | 3'-CAAUGGAUUACCCCCUUUCCGACCCUC-5' | (SEQ ID NO: 3734) |
| LDHA-810 Target: | 5'-GTTACCTAATGGGGGAAAGGCTGGGAG-3' | (SEQ ID NO: 5748) |
|  | 5'-ACCUAAUGGGGGAAAGGCUGGGAgt-3' | (SEQ ID NO: 1721) |
|  | 3'-AAUGGAUUACCCCCUUUCCGACCCUCA-5' | (SEQ ID NO: 3735) |
| LDHA-811 Target: | 5'-TTACCTAATGGGGGAAAGGCTGGGAGT-3' | (SEQ ID NO: 5749) |
|  | 5'-CCUAAUGGGGGAAAGGCUGGGAGtt-3' | (SEQ ID NO: 1722) |
|  | 3'-AUGGAUUACCCCCUUUCCGACCCUCAA-5' | (SEQ ID NO: 3736) |
| LDHA-812 Target: | 5'-TACCTAATGGGGGAAAGGCTGGGAGTT-3' | (SEQ ID NO: 5750) |
|  | 5'-CUAAUGGGGGAAAGGCUGGGAGUtc-3' | (SEQ ID NO: 1723) |
|  | 3'-UGGAUUACCCCCUUUCCGACCCUCAAG-5' | (SEQ ID NO: 3737) |
| LDHA-813 Target: | 5'-ACCTAATGGGGGAAAGGCTGGGAGTTC-3' | (SEQ ID NO: 5751) |
|  | 5'-UAAUGGGGGAAAGGCUGGGAGUUca-3' | (SEQ ID NO: 1724) |
|  | 3'-GGAUUACCCCCUUUCCGACCCUCAAGU-5' | (SEQ ID NO: 3738) |
| LDHA-814 Target: | 5'-CCTAATGGGGGAAAGGCTGGGAGTTCA-3' | (SEQ ID NO: 5752) |
|  | 5'-AAUGGGGGAAAGGCUGGGAGUUCac-3' | (SEQ ID NO: 1725) |
|  | 3'-GAUUACCCCCUUUCCGACCCUCAAGUG-5' | (SEQ ID NO: 3739) |
| LDHA-815 Target: | 5'-CTAATGGGGGAAAGGCTGGGAGTTCAC-3' | (SEQ ID NO: 5753) |
|  | 5'-AUGGGGGAAAGGCUGGGAGUUCAcc-3' | (SEQ ID NO: 1726) |
|  | 3'-AUUACCCCCUUUCCGACCCUCAAGUGG-5' | (SEQ ID NO: 3740) |
| LDHA-816 Target: | 5'-TAATGGGGGAAAGGCTGGGAGTTCACC-3' | (SEQ ID NO: 5754) |

TABLE 12-continued

Additional Selected Human Anti-Lactate Dehydrogenase DsiRNA
Agents (Asymmetrics)

```
                  5'-UGGGGGAAAGGCUGGGAGUUCACcc-3'      (SEQ ID NO: 1727)
                  3'-UUACCCCCUUUCCGACCCUCAAGUGGG-5'    (SEQ ID NO: 3741)
LDHA-817 Target:  5'-AATGGGGGAAAGGCTGGGAGTTCACCC-3'    (SEQ ID NO: 5755)

5'-GGGGGAAAGGCUGGGAGUUCACCca-3'      (SEQ ID NO: 1728)
                  3'-UACCCCCUUUCCGACCCUCAAGUGGGU-5'    (SEQ ID NO: 3742)
LDHA-818 Target:  5'-ATGGGGGAAAGGCTGGGAGTTCACCCA-3'    (SEQ ID NO: 5756)

5'-GGGGAAAGGCUGGGAGUUCACCCat-3'      (SEQ ID NO: 1729)
                  3'-ACCCCCUUUCCGACCCUCAAGUGGGUA-5'    (SEQ ID NO: 3743)
LDHA-819 Target:  5'-TGGGGGAAAGGCTGGGAGTTCACCCAT-3'    (SEQ ID NO: 5757)

5'-GGGAAAGGCUGGGAGUUCACCCAtt-3'      (SEQ ID NO: 1730)
                  3'-CCCCCUUUCCGACCCUCAAGUGGGUAA-5'    (SEQ ID NO: 3744)
LDHA-820 Target:  5'-GGGGGAAAGGCTGGGAGTTCACCCATT-3'    (SEQ ID NO: 5758)

5'-GGAAAGGCUGGGAGUUCACCCAUta-3'      (SEQ ID NO: 1731)
                  3'-CCCCUUUCCGACCCUCAAGUGGGUAAU-5'    (SEQ ID NO: 3745)
LDHA-821 Target:  5'-GGGGAAAGGCTGGGAGTTCACCCATTA-3'    (SEQ ID NO: 5759)

5'-GAAAGGCUGGGAGUUCACCCAUUaa-3'      (SEQ ID NO: 1732)
                  3'-CCCUUUCCGACCCUCAAGUGGGUAAUU-5'    (SEQ ID NO: 3746)
LDHA-822 Target:  5'-GGGAAAGGCTGGGAGTTCACCCATTAA-3'    (SEQ ID NO: 5760)

5'-AAAGGCUGGGAGUUCACCCAUUAag-3'      (SEQ ID NO: 1733)
                  3'-CCUUUCCGACCCUCAAGUGGGUAAUUC-5'    (SEQ ID NO: 3747)
LDHA-823 Target:  5'-GGAAAGGCTGGGAGTTCACCCATTAAG-3'    (SEQ ID NO: 5761)

5'-AAGGCUGGGAGUUCACCCAUUAAgc-3'      (SEQ ID NO: 1734)
                  3'-CUUUCCGACCCUCAAGUGGGUAAUUCG-5'    (SEQ ID NO: 3748)
LDHA-824 Target:  5'-GAAAGGCTGGGAGTTCACCCATTAAGC-3'    (SEQ ID NO: 5762)

5'-AGGCUGGGAGUUCACCCAUUAAGct-3'      (SEQ ID NO: 1735)
                  3'-UUUCCGACCCUCAAGUGGGUAAUUCGA-5'    (SEQ ID NO: 3749)
LDHA-825 Target:  5'-AAAGGCTGGGAGTTCACCCATTAAGCT-3'    (SEQ ID NO: 5763)

5'-GGCUGGGAGUUCACCCAUUAAGCtg-3'      (SEQ ID NO: 1736)
                  3'-UUCCGACCCUCAAGUGGGUAAUUCGAC-5'    (SEQ ID NO: 3750)
LDHA-826 Target:  5'-AAGGCTGGGAGTTCACCCATTAAGCTG-3'    (SEQ ID NO: 5764)

5'-GCUGGGAGUUCACCCAUUAAGCUgt-3'      (SEQ ID NO: 1737)
                  3'-UCCGACCCUCAAGUGGGUAAUUCGACA-5'    (SEQ ID NO: 3751)
LDHA-827 Target:  5'-AGGCTGGGAGTTCACCCATTAAGCTGT-3'    (SEQ ID NO: 5765)

5'-CUGGGAGUUCACCCAUUAAGCUGtc-3'      (SEQ ID NO: 1738)
                  3'-CCGACCCUCAAGUGGGUAAUUCGACAG-5'    (SEQ ID NO: 3752)
LDHA-828 Target:  5'-GGCTGGGAGTTCACCCATTAAGCTGTC-3'    (SEQ ID NO: 5766)

5'-UGGGAGUUCACCCAUUAAGCUGUca-3'      (SEQ ID NO: 1739)
                  3'-CGACCCUCAAGUGGGUAAUUCGACAGU-5'    (SEQ ID NO: 3753)
LDHA-829 Target:  5'-GCTGGGAGTTCACCCATTAAGCTGTCA-3'    (SEQ ID NO: 5767)

5'-GGGAGUUCACCCAUUAAGCUGUCat-3'      (SEQ ID NO: 1740)
                  3'-GACCCUCAAGUGGGUAAUUCGACAGUA-5'    (SEQ ID NO: 3754)
LDHA-830 Target:  5'-CTGGGAGTTCACCCATTAAGCTGTCAT-3'    (SEQ ID NO: 5768)

5'-GGAGUUCACCCAUUAAGCUGUCAtg-3'      (SEQ ID NO: 1741)
                  3'-ACCCUCAAGUGGGUAAUUCGACAGUAC-5'    (SEQ ID NO: 3755)
LDHA-831 Target:  5'-TGGGAGTTCACCCATTAAGCTGTCATG-3'    (SEQ ID NO: 5769)

5'-GAGUUCACCCAUUAAGCUGUCAUgg-3'      (SEQ ID NO: 1742)
                  3'-CCCUCAAGUGGGUAAUUCGACAGUACC-5'    (SEQ ID NO: 3756)
LDHA-832 Target:  5'-GGGAGTTCACCCATTAAGCTGTCATGG-3'    (SEQ ID NO: 5770)

5'-AGUUCACCCAUUAAGCUGUCAUGgg-3'      (SEQ ID NO: 1743)
                  3'-CCUCAAGUGGGUAAUUCGACAGUACCC-5'    (SEQ ID NO: 3757)
LDHA-833 Target:  5'-GGAGTTCACCCATTAAGCTGTCATGGG-3'    (SEQ ID NO: 5771)

5'-GUUCACCCAUUAAGCUGUCAUGGgt-3'      (SEQ ID NO: 1744)
                  3'-CUCAAGUGGGUAAUUCGACAGUACCCA-5'    (SEQ ID NO: 3758)
LDHA-834 Target:  5'-GAGTTCACCCATTAAGCTGTCATGGGT-3'    (SEQ ID NO: 5772)

5'-UUCACCCAUUAAGCUGUCAUGGGtg-3'      (SEQ ID NO: 1745)
                  3'-UCAAGUGGGUAAUUCGACAGUACCCAC-5'    (SEQ ID NO: 3759)
LDHA-835 Target:  5'-AGTTCACCCATTAAGCTGTCATGGGTG-3'    (SEQ ID NO: 5773)
```

TABLE 12-continued

Additional Selected Human Anti-Lactate Dehydrogenase DsiRNA Agents (Asymmetrics)

| | | |
|---|---|---|
| | 5'-UCACCCAUUAAGCUGUCAUGGGUgg-3' | (SEQ ID NO: 1746) |
| | 3'-CAAGUGGGUAAUUCGACAGUACCCACC-5' | (SEQ ID NO: 3760) |
| LDHA-836 Target: | 5'-GTTCACCCATTAAGCTGTCATGGGTGG-3' | (SEQ ID NO: 5774) |
| | 5'-CACCCAUUAAGCUGUCAUGGGUGgg-3' | (SEQ ID NO: 1747) |
| | 3'-AAGUGGGUAAUUCGACAGUACCCACCC-5' | (SEQ ID NO: 3761) |
| LDHA-837 Target: | 5'-TTCACCCATTAAGCTGTCATGGGTGGG-3' | (SEQ ID NO: 5775) |
| | 5'-ACCCAUUAAGCUGUCAUGGGUGGgt-3' | (SEQ ID NO: 1748) |
| | 3'-AGUGGGUAAUUCGACAGUACCCACCCA-5' | (SEQ ID NO: 3762) |
| LDHA-838 Target: | 5'-TCACCCATTAAGCTGTCATGGGTGGGT-3' | (SEQ ID NO: 5776) |
| | 5'-CCCAUUAAGCUGUCAUGGGUGGGtc-3' | (SEQ ID NO: 1749) |
| | 3'-GUGGGUAAUUCGACAGUACCCACCCAG-5' | (SEQ ID NO: 3763) |
| LDHA-839 Target: | 5'-CACCCATTAAGCTGTCATGGGTGGGTC-3' | (SEQ ID NO: 5777) |
| | 5'-CCAUUAAGCUGUCAUGGGUGGGUcc-3' | (SEQ ID NO: 1750) |
| | 3'-UGGGUAAUUCGACAGUACCCACCCAGG-5' | (SEQ ID NO: 3764) |
| LDHA-840 Target: | 5'-ACCCATTAAGCTGTCATGGGTGGGTCC-3' | (SEQ ID NO: 5778) |
| | 5'-CAUUAAGCUGUCAUGGGUGGGUCct-3' | (SEQ ID NO: 1751) |
| | 3'-GGGUAAUUCGACAGUACCCACCCAGGA-5' | (SEQ ID NO: 3765) |
| LDHA-841 Target: | 5'-CCCATTAAGCTGTCATGGGTGGGTCCT-3' | (SEQ ID NO: 5779) |
| | 5'-AUUAAGCUGUCAUGGGUGGGUCCtt-3' | (SEQ ID NO: 1752) |
| | 3'-GGUAAUUCGACAGUACCCACCCAGGAA-5' | (SEQ ID NO: 3766) |
| LDHA-842 Target: | 5'-CCATTAAGCTGTCATGGGTGGGTCCTT-3' | (SEQ ID NO: 5780) |
| | 5'-UUAAGCUGUCAUGGGUGGGUCCUtg-3' | (SEQ ID NO: 1753) |
| | 3'-GUAAUUCGACAGUACCCACCCAGGAAC-5' | (SEQ ID NO: 3767) |
| LDHA-843 Target: | 5'-CATTAAGCTGTCATGGGTGGGTCCTTG-3' | (SEQ ID NO: 5781) |
| | 5'-UAAGCUGUCAUGGGUGGGUCCUUgg-3' | (SEQ ID NO: 1754) |
| | 3'-UAAUUCGACAGUACCCACCCAGGAACC-5' | (SEQ ID NO: 3768) |
| LDHA-844 Target: | 5'-ATTAAGCTGTCATGGGTGGGTCCTTGG-3' | (SEQ ID NO: 5782) |
| | 5'-AAGCUGUCAUGGGUGGGUCCUUGgg-3' | (SEQ ID NO: 1755) |
| | 3'-AAUUCGACAGUACCCACCCAGGAACCC-5' | (SEQ ID NO: 3769) |
| LDHA-845 Target: | 5'-TTAAGCTGTCATGGGTGGGTCCTTGGG-3' | (SEQ ID NO: 5783) |
| | 5'-AGCUGUCAUGGGUGGGUCCUUGGgg-3' | (SEQ ID NO: 1756) |
| | 3'-AUUCGACAGUACCCACCCAGGAACCCC-5' | (SEQ ID NO: 3770) |
| LDHA-846 Target: | 5'-TAAGCTGTCATGGGTGGGTCCTTGGGG-3' | (SEQ ID NO: 5784) |
| | 5'-GCUGUCAUGGGUGGGUCCUUGGGga-3' | (SEQ ID NO: 1757) |
| | 3'-UUCGACAGUACCCACCCAGGAACCCCU-5' | (SEQ ID NO: 3771) |
| LDHA-847 Target: | 5'-AAGCTGTCATGGGTGGGTCCTTGGGGA-3' | (SEQ ID NO: 5785) |
| | 5'-CUGUCAUGGGUGGGUCCUUGGGGaa-3' | (SEQ ID NO: 1758) |
| | 3'-UCGACAGUACCCACCCAGGAACCCCUU-5' | (SEQ ID NO: 3772) |
| LDHA-848 Target: | 5'-AGCTGTCATGGGTGGGTCCTTGGGGAA-3' | (SEQ ID NO: 5786) |
| | 5'-UGUCAUGGGUGGGUCCUUGGGGAac-3' | (SEQ ID NO: 1759) |
| | 3'-CGACAGUACCCACCCAGGAACCCCUUG-5' | (SEQ ID NO: 3773) |
| LDHA-849 Target: | 5'-GCTGTCATGGGTGGGTCCTTGGGGAAC-3' | (SEQ ID NO: 5787) |
| | 5'-GUCAUGGGUGGGUCCUUGGGGAAca-3' | (SEQ ID NO: 1760) |
| | 3'-GACAGUACCCACCCAGGAACCCCUUGU-5' | (SEQ ID NO: 3774) |
| LDHA-850 Target: | 5'-CTGTCATGGGTGGGTCCTTGGGGAACA-3' | (SEQ ID NO: 5788) |
| | 5'-UCAUGGGUGGGUCCUUGGGGAACat-3' | (SEQ ID NO: 1761) |
| | 3'-ACAGUACCCACCCAGGAACCCCUUGUA-5' | (SEQ ID NO: 3775) |
| LDHA-851 Target: | 5'-TGTCATGGGTGGGTCCTTGGGGAACAT-3' | (SEQ ID NO: 5789) |
| | 5'-CAUGGGUGGGUCCUUGGGGAACAtg-3' | (SEQ ID NO: 1762) |
| | 3'-CAGUACCCACCCAGGAACCCCUUGUAC-5' | (SEQ ID NO: 3776) |
| LDHA-852 Target: | 5'-GTCATGGGTGGGTCCTTGGGGAACATG-3' | (SEQ ID NO: 5790) |
| | 5'-AUGGGUGGGUCCUUGGGGAACAUgg-3' | (SEQ ID NO: 1763) |
| | 3'-AGUACCCACCCAGGAACCCCUUGUACC-5' | (SEQ ID NO: 3777) |
| LDHA-853 Target: | 5'-TCATGGGTGGGTCCTTGGGGAACATGG-3' | (SEQ ID NO: 5791) |
| | 5'-UGGGUGGGUCCUUGGGGAACAUGga-3' | (SEQ ID NO: 1764) |
| | 3'-GUACCCACCCAGGAACCCCUUGUACCU-5' | (SEQ ID NO: 3778) |
| LDHA-854 Target: | 5'-CATGGGTGGGTCCTTGGGGAACATGGA-3' | (SEQ ID NO: 5792) |

TABLE 12-continued

Additional Selected Human Anti-Lactate Dehydrogenase DsiRNA Agents (Asymmetrics)

| | | |
|---|---|---|
| LDHA-855 Target: | 5'-GGGUGGGUCCUUGGGGAACAUGGAg-3'<br>3'-UACCCACCCAGGAACCCCUUGUACCUC-5'<br>5'-ATGGGTGGGTCCTTGGGGAACATGGAG-3' | (SEQ ID NO: 1765)<br>(SEQ ID NO: 3779)<br>(SEQ ID NO: 5793) |
| LDHA-856 Target: | 5'-GGUGGGUCCUUGGGGAACAUGGAga-3'<br>3'-ACCCACCCAGGAACCCCUUGUACCUCU-5'<br>5'-TGGGTGGGTCCTTGGGGAACATGGAGA-3' | (SEQ ID NO: 1766)<br>(SEQ ID NO: 3780)<br>(SEQ ID NO: 5794) |
| LDHA-857 Target: | 5'-GUGGGUCCUUGGGGAACAUGGAGat-3'<br>3'-CCCACCCAGGAACCCCUUGUACCUCUA-5'<br>5'-GGGTGGGTCCTTGGGGAACATGGAGAT-3' | (SEQ ID NO: 1767)<br>(SEQ ID NO: 3781)<br>(SEQ ID NO: 5795) |
| LDHA-858 Target: | 5'-UGGGUCCUUGGGGAACAUGGAGAtt-3'<br>3'-CCACCCAGGAACCCCUUGUACCUCUAA-5'<br>5'-GGTGGGTCCTTGGGGAACATGGAGATT-3' | (SEQ ID NO: 1768)<br>(SEQ ID NO: 3782)<br>(SEQ ID NO: 5796) |
| LDHA-859 Target: | 5'-GGGUCCUUGGGGAACAUGGAGAUtc-3'<br>3'-CACCCAGGAACCCCUUGUACCUCUAAG-5'<br>5'-GTGGGTCCTTGGGGAACATGGAGATTC-3' | (SEQ ID NO: 1769)<br>(SEQ ID NO: 3783)<br>(SEQ ID NO: 5797) |
| LDHA-860 Target: | 5'-GGUCCUUGGGGAACAUGGAGAUUcc-3'<br>3'-ACCCAGGAACCCCUUGUACCUCUAAGG-5'<br>5'-TGGGTCCTTGGGGAACATGGAGATTCC-3' | (SEQ ID NO: 1770)<br>(SEQ ID NO: 3784)<br>(SEQ ID NO: 5798) |
| LDHA-861 Target: | 5'-GUCCUUGGGGAACAUGGAGAUUCca-3'<br>3'-CCCAGGAACCCCUUGUACCUCUAAGGU-5'<br>5'-GGGTCCTTGGGGAACATGGAGATTCCA-3' | (SEQ ID NO: 1771)<br>(SEQ ID NO: 3785)<br>(SEQ ID NO: 5799) |
| LDHA-862 Target: | 5'-UCCUUGGGGAACAUGGAGAUUCCag-3'<br>3'-CCAGGAACCCCUUGUACCUCUAAGGUC-5'<br>5'-GGTCCTTGGGGAACATGGAGATTCCAG-3' | (SEQ ID NO: 1772)<br>(SEQ ID NO: 3786)<br>(SEQ ID NO: 5800) |
| LDHA-863 Target: | 5'-CCUUGGGGAACAUGGAGAUUCCAgt-3'<br>3'-CAGGAACCCCUUGUACCUCUAAGGUCA-5'<br>5'-GTCCTTGGGGAACATGGAGATTCCAGT-3' | (SEQ ID NO: 1773)<br>(SEQ ID NO: 3787)<br>(SEQ ID NO: 5801) |
| LDHA-864 Target: | 5'-CUUGGGGAACAUGGAGAUUCCAGtg-3'<br>3'-AGGAACCCCUUGUACCUCUAAGGUCAC-5'<br>5'-TCCTTGGGGAACATGGAGATTCCAGTG-3' | (SEQ ID NO: 1774)<br>(SEQ ID NO: 3788)<br>(SEQ ID NO: 5802) |
| LDHA-865 Target: | 5'-UUGGGGAACAUGGAGAUUCCAGUgt-3'<br>3'-GGAACCCCUUGUACCUCUAAGGUCACA-5'<br>5'-CCTTGGGGAACATGGAGATTCCAGTGT-3' | (SEQ ID NO: 1775)<br>(SEQ ID NO: 3789)<br>(SEQ ID NO: 5803) |
| LDHA-866 Target: | 5'-UGGGGAACAUGGAGAUUCCAGUGtg-3'<br>3'-GAACCCCUUGUACCUCUAAGGUCACAC-5'<br>5'-CTTGGGGAACATGGAGATTCCAGTGTG-3' | (SEQ ID NO: 1776)<br>(SEQ ID NO: 3790)<br>(SEQ ID NO: 5804) |
| LDHA-867 Target: | 5'-GGGGAACAUGGAGAUUCCAGUGUgc-3'<br>3'-AACCCCUUGUACCUCUAAGGUCACACG-5'<br>5'-TTGGGGAACATGGAGATTCCAGTGTGC-3' | (SEQ ID NO: 1777)<br>(SEQ ID NO: 3791)<br>(SEQ ID NO: 5805) |
| LDHA-868 Target: | 5'-GGGAACAUGGAGAUUCCAGUGUGcc-3'<br>3'-ACCCCUUGUACCUCUAAGGUCACACGG-5'<br>5'-TGGGGAACATGGAGATTCCAGTGTGCC-3' | (SEQ ID NO: 1778)<br>(SEQ ID NO: 3792)<br>(SEQ ID NO: 5806) |
| LDHA-869 Target: | 5'-GGAACAUGGAGAUUCCAGUGUGCct-3'<br>3'-CCCCUUGUACCUCUAAGGUCACACGGA-5'<br>5'-GGGGAACATGGAGATTCCAGTGTGCCT-3' | (SEQ ID NO: 1779)<br>(SEQ ID NO: 3793)<br>(SEQ ID NO: 5807) |
| LDHA-870 Target: | 5'-GAACAUGGAGAUUCCAGUGUGCCtg-3'<br>3'-CCCUUGUACCUCUAAGGUCACACGGAC-5'<br>5'-GGGAACATGGAGATTCCAGTGTGCCTG-3' | (SEQ ID NO: 1780)<br>(SEQ ID NO: 3794)<br>(SEQ ID NO: 5808) |
| LDHA-871 Target: | 5'-AACAUGGAGAUUCCAGUGUGCCUgt-3'<br>3'-CCUUGUACCUCUAAGGUCACACGGACA-5'<br>5'-GGAACATGGAGATTCCAGTGTGCCTGT-3' | (SEQ ID NO: 1781)<br>(SEQ ID NO: 3795)<br>(SEQ ID NO: 5809) |
| LDHA-872 Target: | 5'-ACAUGGAGAUUCCAGUGUGCCUGta-3'<br>3'-CUUGUACCUCUAAGGUCACACGGACAU-5'<br>5'-GAACATGGAGATTCCAGTGTGCCTGTA-3' | (SEQ ID NO: 1782)<br>(SEQ ID NO: 3796)<br>(SEQ ID NO: 5810) |
| LDHA-873 Target: | 5'-CAUGGAGAUUCCAGUGUGCCUGUat-3'<br>3'-UUGUACCUCUAAGGUCACACGGACAUA-5'<br>5'-AACATGGAGATTCCAGTGTGCCTGTAT-3' | (SEQ ID NO: 1783)<br>(SEQ ID NO: 3797)<br>(SEQ ID NO: 5811) |

TABLE 12-continued

Additional Selected Human Anti-Lactate Dehydrogenase DsiRNA Agents (Asymmetrics)

| | | |
|---|---|---|
| LDHA-874 | 5'-AUGGAGAUUCCAGUGUGCCUGUAtg-3'<br>3'-UGUACCUCUAAGGUCACACGGACAUAC-5'<br>Target: 5'-ACATGGAGATTCCAGTGTGCCTGTATG-3' | (SEQ ID NO: 1784)<br>(SEQ ID NO: 3798)<br>(SEQ ID NO: 5812) |
| LDHA-875 | 5'-UGGAGAUUCCAGUGUGCCUGUAUgg-3'<br>3'-GUACCUCUAAGGUCACACGGACAUACC-5'<br>Target: 5'-CATGGAGATTCCAGTGTGCCTGTATGG-3' | (SEQ ID NO: 1785)<br>(SEQ ID NO: 3799)<br>(SEQ ID NO: 5813) |
| LDHA-876 | 5'-GGAGAUUCCAGUGUGCCUGUAUGga-3'<br>3'-UACCUCUAAGGUCACACGGACAUACCU-5'<br>Target: 5'-ATGGAGATTCCAGTGTGCCTGTATGGA-3' | (SEQ ID NO: 1786)<br>(SEQ ID NO: 3800)<br>(SEQ ID NO: 5814) |
| LDHA-877 | 5'-GAGAUUCCAGUGUGCCUGUAUGGag-3'<br>3'-ACCUCUAAGGUCACACGGACAUACCUC-5'<br>Target: 5'-TGGAGATTCCAGTGTGCCTGTATGGAG-3' | (SEQ ID NO: 1787)<br>(SEQ ID NO: 3801)<br>(SEQ ID NO: 5815) |
| LDHA-878 | 5'-AGAUUCCAGUGUGCCUGUAUGGAgt-3'<br>3'-CCUCUAAGGUCACACGGACAUACCUCA-5'<br>Target: 5'-GGAGATTCCAGTGTGCCTGTATGGAGT-3' | (SEQ ID NO: 1788)<br>(SEQ ID NO: 3802)<br>(SEQ ID NO: 5816) |
| LDHA-879 | 5'-GAUUCCAGUGUGCCUGUAUGGAGtg-3'<br>3'-CUCUAAGGUCACACGGACAUACCUCAC-5'<br>Target: 5'-GAGATTCCAGTGTGCCTGTATGGAGTG-3' | (SEQ ID NO: 1789)<br>(SEQ ID NO: 3803)<br>(SEQ ID NO: 5817) |
| LDHA-880 | 5'-AUUCCAGUGUGCCUGUAUGGAGUgg-3'<br>3'-UCUAAGGUCACACGGACAUACCUCACC-5'<br>Target: 5'-AGATTCCAGTGTGCCTGTATGGAGTGG-3' | (SEQ ID NO: 1790)<br>(SEQ ID NO: 3804)<br>(SEQ ID NO: 5818) |
| LDHA-881 | 5'-UUCCAGUGUGCCUGUAUGGAGUGga-3'<br>3'-CUAAGGUCACACGGACAUACCUCACCU-5'<br>Target: 5'-GATTCCAGTGTGCCTGTATGGAGTGGA-3' | (SEQ ID NO: 1791)<br>(SEQ ID NO: 3805)<br>(SEQ ID NO: 5819) |
| LDHA-882 | 5'-UCCAGUGUGCCUGUAUGGAGUGGaa-3'<br>3'-UAAGGUCACACGGACAUACCUCACCUU-5'<br>Target: 5'-ATTCCAGTGTGCCTGTATGGAGTGGAA-3' | (SEQ ID NO: 1792)<br>(SEQ ID NO: 3806)<br>(SEQ ID NO: 5820) |
| LDHA-883 | 5'-CCAGUGUGCCUGUAUGGAGUGGAat-3'<br>3'-AAGGUCACACGGACAUACCUCACCUUA-5'<br>Target: 5'-TTCCAGTGTGCCTGTATGGAGTGGAAT-3' | (SEQ ID NO: 1793)<br>(SEQ ID NO: 3807)<br>(SEQ ID NO: 5821) |
| LDHA-884 | 5'-CAGUGUGCCUGUAUGGAGUGGAAtg-3'<br>3'-AGGUCACACGGACAUACCUCACCUUAC-5'<br>Target: 5'-TCCAGTGTGCCTGTATGGAGTGGAATG-3' | (SEQ ID NO: 1794)<br>(SEQ ID NO: 3808)<br>(SEQ ID NO: 5822) |
| LDHA-885 | 5'-AGUGUGCCUGUAUGGAGUGGAAUga-3'<br>3'-GGUCACACGGACAUACCUCACCUUACU-5'<br>Target: 5'-CCAGTGTGCCTGTATGGAGTGGAATGA-3' | (SEQ ID NO: 1795)<br>(SEQ ID NO: 3809)<br>(SEQ ID NO: 5823) |
| LDHA-886 | 5'-GUGUGCCUGUAUGGAGUGGAAUGaa-3'<br>3'-GUCACACGGACAUACCUCACCUUACUU-5'<br>Target: 5'-CAGTGTGCCTGTATGGAGTGGAATGAA-3' | (SEQ ID NO: 1796)<br>(SEQ ID NO: 3810)<br>(SEQ ID NO: 5824) |
| LDHA-887 | 5'-UGUGCCUGUAUGGAGUGGAAUGAat-3'<br>3'-UCACACGGACAUACCUCACCUUACUUA-5'<br>Target: 5'-AGTGTGCCTGTATGGAGTGGAATGAAT-3' | (SEQ ID NO: 1797)<br>(SEQ ID NO: 3811)<br>(SEQ ID NO: 5825) |
| LDHA-888 | 5'-GUGCCUGUAUGGAGUGGAAUGAAtg-3'<br>3'-CACACGGACAUACCUCACCUUACUUAC-5'<br>Target: 5'-GTGTGCCTGTATGGAGTGGAATGAATG-3' | (SEQ ID NO: 1798)<br>(SEQ ID NO: 3812)<br>(SEQ ID NO: 5826) |
| LDHA-889 | 5'-UGCCUGUAUGGAGUGGAAUGAAUgt-3'<br>3'-ACACGGACAUACCUCACCUUACUUACA-5'<br>Target: 5'-TGTGCCTGTATGGAGTGGAATGAATGT-3' | (SEQ ID NO: 1799)<br>(SEQ ID NO: 3813)<br>(SEQ ID NO: 5827) |
| LDHA-890 | 5'-GCCUGUAUGGAGUGGAAUGAAUGtt-3'<br>3'-CACGGACAUACCUCACCUUACUUACAA-5'<br>Target: 5'-GTGCCTGTATGGAGTGGAATGAATGTT-3' | (SEQ ID NO: 1800)<br>(SEQ ID NO: 3814)<br>(SEQ ID NO: 5828) |
| LDHA-893 | 5'-UGUAUGGAGUGGAAUGAAUGUUGct-3'<br>3'-GGACAUACCUCACCUUACUUACAACGA-5'<br>Target: 5'-CCTGTATGGAGTGGAATGAATGTTGCT-3' | (SEQ ID NO: 1801)<br>(SEQ ID NO: 3815)<br>(SEQ ID NO: 5829) |
| LDHA-894 | 5'-GUAUGGAGUGGAAUGAAUGUUGCtg-3'<br>3'-GACAUACCUCACCUUACUUACAACGAC-5'<br>Target: 5'-CTGTATGGAGTGGAATGAATGTTGCTG-3' | (SEQ ID NO: 1802)<br>(SEQ ID NO: 3816)<br>(SEQ ID NO: 5830) |

TABLE 12-continued

Additional Selected Human Anti-Lactate Dehydrogenase DsiRNA Agents (Asymmetrics)

| | | |
|---|---|---|
| LDHA-895 Target: | 5'-UAUGGAGUGGAAUGAAUGUUGCUgg-3'<br>3'-ACAUACCUCACCUUACUUACAACGACC-5'<br>5'-TGTATGGAGTGGAATGAATGTTGCTGG-3' | (SEQ ID NO: 1803)<br>(SEQ ID NO: 3817)<br>(SEQ ID NO: 5831) |
| LDHA-896 Target: | 5'-AUGGAGUGGAAUGAAUGUUGCUGgt-3'<br>3'-CAUACCUCACCUUACUUACAACGACCA-5'<br>5'-GTATGGAGTGGAATGAATGTTGCTGGT-3' | (SEQ ID NO: 1804)<br>(SEQ ID NO: 3818)<br>(SEQ ID NO: 5832) |
| LDHA-897 Target: | 5'-UGGAGUGGAAUGAAUGUUGCUGGtg-3'<br>3'-AUACCUCACCUUACUUACAACGACCAC-5'<br>5'-TATGGAGTGGAATGAATGTTGCTGGTG-3' | (SEQ ID NO: 1805)<br>(SEQ ID NO: 3819)<br>(SEQ ID NO: 5833) |
| LDHA-898 Target: | 5'-GGAGUGGAAUGAAUGUUGCUGGUgt-3'<br>3'-UACCUCACCUUACUUACAACGACCACA-5'<br>5'-ATGGAGTGGAATGAATGTTGCTGGTGT-3' | (SEQ ID NO: 1806)<br>(SEQ ID NO: 3820)<br>(SEQ ID NO: 5834) |
| LDHA-899 Target: | 5'-GAGUGGAAUGAAUGUUGCUGGUGtc-3'<br>3'-ACCUCACCUUACUUACAACGACCACAG-5'<br>5'-TGGAGTGGAATGAATGTTGCTGGTGTC-3' | (SEQ ID NO: 1807)<br>(SEQ ID NO: 3821)<br>(SEQ ID NO: 5835) |
| LDHA-900 Target: | 5'-AGUGGAAUGAAUGUUGCUGGUGUct-3'<br>3'-CCUCACCUUACUUACAACGACCACAGA-5'<br>5'-GGAGTGGAATGAATGTTGCTGGTGTCT-3' | (SEQ ID NO: 1808)<br>(SEQ ID NO: 3822)<br>(SEQ ID NO: 5836) |
| LDHA-901 Target: | 5'-GUGGAAUGAAUGUUGCUGGUGUCtc-3'<br>3'-CUCACCUUACUUACAACGACCACAGAG-5'<br>5'-GAGTGGAATGAATGTTGCTGGTGTCTC-3' | (SEQ ID NO: 1809)<br>(SEQ ID NO: 3823)<br>(SEQ ID NO: 5837) |
| LDHA-902 Target: | 5'-UGGAAUGAAUGUUGCUGGUGUCUct-3'<br>3'-UCACCUUACUUACAACGACCACAGAGA-5'<br>5'-AGTGGAATGAATGTTGCTGGTGTCTCT-3' | (SEQ ID NO: 1810)<br>(SEQ ID NO: 3824)<br>(SEQ ID NO: 5838) |
| LDHA-903 Target: | 5'-GGAAUGAAUGUUGCUGGUGUCUCtc-3'<br>3'-CACCUUACUUACAACGACCACAGAGAG-5'<br>5'-GTGGAATGAATGTTGCTGGTGTCTCTC-3' | (SEQ ID NO: 1811)<br>(SEQ ID NO: 3825)<br>(SEQ ID NO: 5839) |
| LDHA-904 Target: | 5'-GAAUGAAUGUUGCUGGUGUCUCUct-3'<br>3'-ACCUUACUUACAACGACCACAGAGAGA-5'<br>5'-TGGAATGAATGTTGCTGGTGTCTCTCT-3' | (SEQ ID NO: 1812)<br>(SEQ ID NO: 3826)<br>(SEQ ID NO: 5840) |
| LDHA-905 Target: | 5'-AAUGAAUGUUGCUGGUGUCUCUCtg-3'<br>3'-CCUUACUUACAACGACCACAGAGAGAC-5'<br>5'-GGAATGAATGTTGCTGGTGTCTCTCTG-3' | (SEQ ID NO: 1813)<br>(SEQ ID NO: 3827)<br>(SEQ ID NO: 5841) |
| LDHA-906 Target: | 5'-AUGAAUGUUGCUGGUGUCUCUCUga-3'<br>3'-CUUACUUACAACGACCACAGAGAGACU-5'<br>5'-GAATGAATGTTGCTGGTGTCTCTCTGA-3' | (SEQ ID NO: 1814)<br>(SEQ ID NO: 3828)<br>(SEQ ID NO: 5842) |
| LDHA-908 Target: | 5'-GAAUGUUGCUGGUGUCUCUCUGAag-3'<br>3'-UACUUACAACGACCACAGAGAGACUUC-5'<br>5'-ATGAATGTTGCTGGTGTCTCTCTGAAG-3' | (SEQ ID NO: 1815)<br>(SEQ ID NO: 3829)<br>(SEQ ID NO: 5843) |
| LDHA-909 Target: | 5'-AAUGUUGCUGGUGUCUCUCUGAAga-3'<br>3'-ACUUACAACGACCACAGAGAGACUUCU-5'<br>5'-TGAATGTTGCTGGTGTCTCTCTGAAGA-3' | (SEQ ID NO: 1816)<br>(SEQ ID NO: 3830)<br>(SEQ ID NO: 5844) |
| LDHA-910 Target: | 5'-AUGUUGCUGGUGUCUCUCUGAAGac-3'<br>3'-CUUACAACGACCACAGAGAGACUUCUG-5'<br>5'-GAATGTTGCTGGTGTCTCTCTGAAGAC-3' | (SEQ ID NO: 1817)<br>(SEQ ID NO: 3831)<br>(SEQ ID NO: 5845) |
| LDHA-911 Target: | 5'-UGUUGCUGGUGUCUCUCUGAAGAct-3'<br>3'-UUACAACGACCACAGAGAGACUUCUGA-5'<br>5'-AATGTTGCTGGTGTCTCTCTGAAGACT-3' | (SEQ ID NO: 1818)<br>(SEQ ID NO: 3832)<br>(SEQ ID NO: 5846) |
| LDHA-912 Target: | 5'-GUUGCUGGUGUCUCUCUGAAGACtc-3'<br>3'-UACAACGACCACAGAGAGACUUCUGAG-5'<br>5'-ATGTTGCTGGTGTCTCTCTGAAGACTC-3' | (SEQ ID NO: 1819)<br>(SEQ ID NO: 3833)<br>(SEQ ID NO: 5847) |
| LDHA-913 Target: | 5'-UUGCUGGUGUCUCUCUGAAGACUct-3'<br>3'-ACAACGACCACAGAGAGACUUCUGAGA-5'<br>5'-TGTTGCTGGTGTCTCTCTGAAGACTCT-3' | (SEQ ID NO: 1820)<br>(SEQ ID NO: 3834)<br>(SEQ ID NO: 5848) |
| LDHA-914 Target: | 5'-UGCUGGUGUCUCUCUGAAGACUCtg-3'<br>3'-CAACGACCACAGAGAGACUUCUGAGAC-5'<br>5'-GTTGCTGGTGTCTCTCTGAAGACTCTG-3' | (SEQ ID NO: 1821)<br>(SEQ ID NO: 3835)<br>(SEQ ID NO: 5849) |

TABLE 12-continued

Additional Selected Human Anti-Lactate Dehydrogenase DsiRNA Agents (Asymmetrics)

| | | |
|---|---|---|
| LDHA-915 | 5'-GCUGGUGUCUCUCUGAAGACUCUGgc-3'<br>3'-AACGACCACAGAGAGACUUCUGAGACG-5'<br>Target: 5'-TTGCTGGTGTCTCTCTGAAGACTCTGC-3' | (SEQ ID NO: 1822)<br>(SEQ ID NO: 3836)<br>(SEQ ID NO: 5850) |
| LDHA-916 | 5'-CUGGUGUCUCUCUGAAGACUCUGca-3'<br>3'-ACGACCACAGAGAGACUUCUGAGACGU-5'<br>Target: 5'-TGCTGGTGTCTCTCTGAAGACTCTGCA-3' | (SEQ ID NO: 1823)<br>(SEQ ID NO: 3837)<br>(SEQ ID NO: 5851) |
| LDHA-917 | 5'-UGGUGUCUCUCUGAAGACUCUGCac-3'<br>3'-CGACCACAGAGAGACUUCUGAGACGUG-5'<br>Target: 5'-GCTGGTGTCTCTCTGAAGACTCTGCAC-3' | (SEQ ID NO: 1824)<br>(SEQ ID NO: 3838)<br>(SEQ ID NO: 5852) |
| LDHA-918 | 5'-GGUGUCUCUCUGAAGACUCUGCAcc-3'<br>3'-GACCACAGAGAGACUUCUGAGACGUGG-5'<br>Target: 5'-CTGGTGTCTCTCTGAAGACTCTGCACC-3' | (SEQ ID NO: 1825)<br>(SEQ ID NO: 3839)<br>(SEQ ID NO: 5853) |
| LDHA-919 | 5'-GUGUCUCUCUGAAGACUCUGCACcc-3'<br>3'-ACCACAGAGAGACUUCUGAGACGUGGG-5'<br>Target: 5'-TGGTGTCTCTCTGAAGACTCTGCACCC-3' | (SEQ ID NO: 1826)<br>(SEQ ID NO: 3840)<br>(SEQ ID NO: 5854) |
| LDHA-920 | 5'-UGUCUCUCUGAAGACUCUGCACCca-3'<br>3'-CCACAGAGAGACUUCUGAGACGUGGGU-5'<br>Target: 5'-GGTGTCTCTCTGAAGACTCTGCACCCA-3' | (SEQ ID NO: 1827)<br>(SEQ ID NO: 3841)<br>(SEQ ID NO: 5855) |
| LDHA-921 | 5'-GUCUCUCUGAAGACUCUGCACCCag-3'<br>3'-CACAGAGAGACUUCUGAGACGUGGGUC-5'<br>Target: 5'-GTGTCTCTCTGAAGACTCTGCACCCAG-3' | (SEQ ID NO: 1828)<br>(SEQ ID NO: 3842)<br>(SEQ ID NO: 5856) |
| LDHA-922 | 5'-UCUCUCUGAAGACUCUGCACCCAga-3'<br>3'-ACAGAGAGACUUCUGAGACGUGGGUCU-5'<br>Target: 5'-TGTCTCTCTGAAGACTCTGCACCCAGA-3' | (SEQ ID NO: 1829)<br>(SEQ ID NO: 3843)<br>(SEQ ID NO: 5857) |
| LDHA-923 | 5'-CUCUCUGAAGACUCUGCACCCAGat-3'<br>3'-CAGAGAGACUUCUGAGACGUGGGUCUA-5'<br>Target: 5'-GTCTCTCTGAAGACTCTGCACCCAGAT-3' | (SEQ ID NO: 1830)<br>(SEQ ID NO: 3844)<br>(SEQ ID NO: 5858) |
| LDHA-924 | 5'-UCUCUGAAGACUCUGCACCCAGAtt-3'<br>3'-AGAGAGACUUCUGAGACGUGGGUCUAA-5'<br>Target: 5'-TCTCTCTGAAGACTCTGCACCCAGATT-3' | (SEQ ID NO: 1831)<br>(SEQ ID NO: 3845)<br>(SEQ ID NO: 5859) |
| LDHA-925 | 5'-CUCUGAAGACUCUGCACCCAGAUtt-3'<br>3'-GAGAGACUUCUGAGACGUGGGUCUAAA-5'<br>Target: 5'-CTCTCTGAAGACTCTGCACCCAGATTT-3' | (SEQ ID NO: 1832)<br>(SEQ ID NO: 3846)<br>(SEQ ID NO: 5860) |
| LDHA-926 | 5'-UCUGAAGACUCUGCACCCAGAUUta-3'<br>3'-AGAGACUUCUGAGACGUGGGUCUAAAU-5'<br>Target: 5'-TCTCTGAAGACTCTGCACCCAGATTTA-3' | (SEQ ID NO: 1833)<br>(SEQ ID NO: 3847)<br>(SEQ ID NO: 5861) |
| LDHA-927 | 5'-CUGAAGACUCUGCACCCAGAUUUag-3'<br>3'-GAGACUUCUGAGACGUGGGUCUAAAUC-5'<br>Target: 5'-CTCTGAAGACTCTGCACCCAGATTTAG-3' | (SEQ ID NO: 1834)<br>(SEQ ID NO: 3848)<br>(SEQ ID NO: 5862) |
| LDHA-928 | 5'-UGAAGACUCUGCACCCAGAUUUAgg-3'<br>3'-AGACUUCUGAGACGUGGGUCUAAAUCC-5'<br>Target: 5'-TCTGAAGACTCTGCACCCAGATTTAGG-3' | (SEQ ID NO: 1835)<br>(SEQ ID NO: 3849)<br>(SEQ ID NO: 5863) |
| LDHA-929 | 5'-GAAGACUCUGCACCCAGAUUUAGgg-3'<br>3'-GACUUCUGAGACGUGGGUCUAAAUCCC-5'<br>Target: 5'-CTGAAGACTCTGCACCCAGATTTAGGG-3' | (SEQ ID NO: 1836)<br>(SEQ ID NO: 3850)<br>(SEQ ID NO: 5864) |
| LDHA-930 | 5'-AAGACUCUGCACCCAGAUUUAGGga-3'<br>3'-ACUUCUGAGACGUGGGUCUAAAUCCCU-5'<br>Target: 5'-TGAAGACTCTGCACCCAGATTTAGGGA-3' | (SEQ ID NO: 1837)<br>(SEQ ID NO: 3851)<br>(SEQ ID NO: 5865) |
| LDHA-931 | 5'-AGACUCUGCACCCAGAUUUAGGGac-3'<br>3'-CUUCUGAGACGUGGGUCUAAAUCCCUG-5'<br>Target: 5'-GAAGACTCTGCACCCAGATTTAGGGAC-3' | (SEQ ID NO: 1838)<br>(SEQ ID NO: 3852)<br>(SEQ ID NO: 5866) |
| LDHA-932 | 5'-GACUCUGCACCCAGAUUUAGGGAct-3'<br>3'-UUCUGAGACGUGGGUCUAAAUCCCUGA-5'<br>Target: 5'-AAGACTCTGCACCCAGATTTAGGGACT-3' | (SEQ ID NO: 1839)<br>(SEQ ID NO: 3853)<br>(SEQ ID NO: 5867) |
| LDHA-933 | 5'-ACUCUGCACCCAGAUUUAGGGACtg-3'<br>3'-UCUGAGACGUGGGUCUAAAUCCCUGAC-5'<br>Target: 5'-AGACTCTGCACCCAGATTTAGGGACTG-3' | (SEQ ID NO: 1840)<br>(SEQ ID NO: 3854)<br>(SEQ ID NO: 5868) |

TABLE 12-continued

Additional Selected Human Anti-Lactate Dehydrogenase DsiRNA Agents (Asymmetrics)

| | | |
|---|---|---|
| LDHA-934 Target: | 5'-CUCUGCACCCAGAUUUAGGGACUga-3'<br>3'-CUGAGACGUGGGUCUAAAUCCCUGACU-5'<br>5'-GACTCTGCACCCAGATTTAGGGACTGA-3' | (SEQ ID NO: 1841)<br>(SEQ ID NO: 3855)<br>(SEQ ID NO: 5869) |
| LDHA-935 Target: | 5'-UCUGCACCCAGAUUUAGGGACUGat-3'<br>3'-UGAGACGUGGGUCUAAAUCCCUGACUA-5'<br>5'-ACTCTGCACCCAGATTTAGGGACTGAT-3' | (SEQ ID NO: 1842)<br>(SEQ ID NO: 3856)<br>(SEQ ID NO: 5870) |
| LDHA-936 Target: | 5'-CUGCACCCAGAUUUAGGGACUGAta-3'<br>3'-GAGACGUGGGUCUAAAUCCCUGACUAU-5'<br>5'-CTCTGCACCCAGATTTAGGGACTGATA-3' | (SEQ ID NO: 1843)<br>(SEQ ID NO: 3857)<br>(SEQ ID NO: 5871) |
| LDHA-937 Target: | 5'-UGCACCCAGAUUUAGGGACUGAUaa-3'<br>3'-AGACGUGGGUCUAAAUCCCUGACUAUU-5'<br>5'-TCTGCACCCAGATTTAGGGACTGATAA-3' | (SEQ ID NO: 1844)<br>(SEQ ID NO: 3858)<br>(SEQ ID NO: 5872) |
| LDHA-938 Target: | 5'-GCACCCAGAUUUAGGGACUGAUAaa-3'<br>3'-GACGUGGGUCUAAAUCCCUGACUAUUU-5'<br>5'-CTGCACCCAGATTTAGGGACTGATAAA-3' | (SEQ ID NO: 1845)<br>(SEQ ID NO: 3859)<br>(SEQ ID NO: 5873) |
| LDHA-939 Target: | 5'-CACCCAGAUUUAGGGACUGAUAAag-3'<br>3'-ACGUGGGUCUAAAUCCCUGACUAUUUC-5'<br>5'-TGCACCCAGATTTAGGGACTGATAAAG-3' | (SEQ ID NO: 1846)<br>(SEQ ID NO: 3860)<br>(SEQ ID NO: 5874) |
| LDHA-940 Target: | 5'-ACCCAGAUUUAGGGACUGAUAAAga-3'<br>3'-CGUGGGUCUAAAUCCCUGACUAUUUCU-5'<br>5'-GCACCCAGATTTAGGGACTGATAAAGA-3' | (SEQ ID NO: 1847)<br>(SEQ ID NO: 3861)<br>(SEQ ID NO: 5875) |
| LDHA-941 Target: | 5'-CCCAGAUUUAGGGACUGAUAAAGat-3'<br>3'-GUGGGUCUAAAUCCCUGACUAUUUCUA-5'<br>5'-CACCCAGATTTAGGGACTGATAAAGAT-3' | (SEQ ID NO: 1848)<br>(SEQ ID NO: 3862)<br>(SEQ ID NO: 5876) |
| LDHA-942 Target: | 5'-CCAGAUUUAGGGACUGAUAAAGAta-3'<br>3'-UGGGUCUAAAUCCCUGACUAUUUCUAU-5'<br>5'-ACCCAGATTTAGGGACTGATAAAGATA-3' | (SEQ ID NO: 1849)<br>(SEQ ID NO: 3863)<br>(SEQ ID NO: 5877) |
| LDHA-943 Target: | 5'-CAGAUUUAGGGACUGAUAAAGAUaa-3'<br>3'-GGGUCUAAAUCCCUGACUAUUUCUAUU-5'<br>5'-CCCAGATTTAGGGACTGATAAAGATAA-3' | (SEQ ID NO: 1850)<br>(SEQ ID NO: 3864)<br>(SEQ ID NO: 5878) |
| LDHA-944 Target: | 5'-AGAUUUAGGGACUGAUAAAGAUAag-3'<br>3'-GGUCUAAAUCCCUGACUAUUUCUAUUC-5'<br>5'-CCAGATTTAGGGACTGATAAAGATAAG-3' | (SEQ ID NO: 1851)<br>(SEQ ID NO: 3865)<br>(SEQ ID NO: 5879) |
| LDHA-945 Target: | 5'-GAUUUAGGGACUGAUAAAGAUAAgg-3'<br>3'-GUCUAAAUCCCUGACUAUUUCUAUUCC-5'<br>5'-CAGATTTAGGGACTGATAAAGATAAGG-3' | (SEQ ID NO: 1852)<br>(SEQ ID NO: 3866)<br>(SEQ ID NO: 5880) |
| LDHA-946 Target: | 5'-AUUUAGGGACUGAUAAAGAUAAGga-3'<br>3'-UCUAAAUCCCUGACUAUUUCUAUUCCU-5'<br>5'-AGATTTAGGGACTGATAAAGATAAGGA-3' | (SEQ ID NO: 1853)<br>(SEQ ID NO: 3867)<br>(SEQ ID NO: 5881) |
| LDHA-947 Target: | 5'-UUUAGGGACUGAUAAAGAUAAGGaa-3'<br>3'-CUAAAUCCCUGACUAUUUCUAUUCCUU-5'<br>5'-GATTTAGGGACTGATAAAGATAAGGAA-3' | (SEQ ID NO: 1854)<br>(SEQ ID NO: 3868)<br>(SEQ ID NO: 5882) |
| LDHA-948 Target: | 5'-UUAGGGACUGAUAAAGAUAAGGAac-3'<br>3'-UAAAUCCCUGACUAUUUCUAUUCCUUG-5'<br>5'-ATTTAGGGACTGATAAAGATAAGGAAC-3' | (SEQ ID NO: 1855)<br>(SEQ ID NO: 3869)<br>(SEQ ID NO: 5883) |
| LDHA-949 Target: | 5'-UAGGGACUGAUAAAGAUAAGGAAca-3'<br>3'-AAAUCCCUGACUAUUUCUAUUCCUUGU-5'<br>5'-TTTAGGGACTGATAAAGATAAGGAACA-3' | (SEQ ID NO: 1856)<br>(SEQ ID NO: 3870)<br>(SEQ ID NO: 5884) |
| LDHA-950 Target: | 5'-AGGGACUGAUAAAGAUAAGGAACag-3'<br>3'-AAUCCCUGACUAUUUCUAUUCCUUGUC-5'<br>5'-TTAGGGACTGATAAAGATAAGGAACAG-3' | (SEQ ID NO: 1857)<br>(SEQ ID NO: 3871)<br>(SEQ ID NO: 5885) |
| LDHA-951 Target: | 5'-GGGACUGAUAAAGAUAAGGAACAgt-3'<br>3'-AUCCCUGACUAUUUCUAUUCCUUGUCA-5'<br>5'-TAGGGACTGATAAAGATAAGGAACAGT-3' | (SEQ ID NO: 1858)<br>(SEQ ID NO: 3872)<br>(SEQ ID NO: 5886) |
| LDHA-953 Target: | 5'-GACUGAUAAAGAUAAGGAACAGUgg-3'<br>3'-CCCUGACUAUUUCUAUUCCUUGUCACC-5'<br>5'-GGGACTGATAAAGATAAGGAACAGTGG-3' | (SEQ ID NO: 1859)<br>(SEQ ID NO: 3873)<br>(SEQ ID NO: 5887) |

TABLE 12-continued

Additional Selected Human Anti-Lactate Dehydrogenase DsiRNA Agents (Asymmetrics)

| | | |
|---|---|---|
| LDHA-954 Target: | 5'-ACUGAUAAAGAUAAGGAACAGUGGa-3'<br>3'-CCUGACUAUUUCUAUUCCUUGUCACCU-5'<br>5'-GGACTGATAAAGATAAGGAACAGTGGA-3' | (SEQ ID NO: 1860)<br>(SEQ ID NO: 3874)<br>(SEQ ID NO: 5888) |
| LDHA-955 Target: | 5'-CUGAUAAAGAUAAGGAACAGUGGaa-3'<br>3'-CUGACUAUUUCUAUUCCUUGUCACCUU-5'<br>5'-GACTGATAAAGATAAGGAACAGTGGAA-3' | (SEQ ID NO: 1861)<br>(SEQ ID NO: 3875)<br>(SEQ ID NO: 5889) |
| LDHA-956 Target: | 5'-UGAUAAAGAUAAGGAACAGUGGAaa-3'<br>3'-UGACUAUUUCUAUUCCUUGUCACCUUU-5'<br>5'-ACTGATAAAGATAAGGAACAGTGGAAA-3' | (SEQ ID NO: 1862)<br>(SEQ ID NO: 3876)<br>(SEQ ID NO: 5890) |
| LDHA-957 Target: | 5'-GAUAAAGAUAAGGAACAGUGGAAag-3'<br>3'-GACUAUUUCUAUUCCUUGUCACCUUUC-5'<br>5'-CTGATAAAGATAAGGAACAGTGGAAAG-3' | (SEQ ID NO: 1863)<br>(SEQ ID NO: 3877)<br>(SEQ ID NO: 5891) |
| LDHA-958 Target: | 5'-AUAAAGAUAAGGAACAGUGGAAAga-3'<br>3'-ACUAUUUCUAUUCCUUGUCACCUUUCU-5'<br>5'-TGATAAAGATAAGGAACAGTGGAAAGA-3' | (SEQ ID NO: 1864)<br>(SEQ ID NO: 3878)<br>(SEQ ID NO: 5892) |
| LDHA-959 Target: | 5'-UAAAGAUAAGGAACAGUGGAAAGag-3'<br>3'-CUAUUUCUAUUCCUUGUCACCUUUCUC-5'<br>5'-GATAAAGATAAGGAACAGTGGAAAGAG-3' | (SEQ ID NO: 1865)<br>(SEQ ID NO: 3879)<br>(SEQ ID NO: 5893) |
| LDHA-960 Target: | 5'-AAAGAUAAGGAACAGUGGAAAGAgg-3'<br>3'-UAUUUCUAUUCCUUGUCACCUUUCUCC-5'<br>5'-ATAAAGATAAGGAACAGTGGAAAGAGG-3' | (SEQ ID NO: 1866)<br>(SEQ ID NO: 3880)<br>(SEQ ID NO: 5894) |
| LDHA-961 Target: | 5'-AAGAUAAGGAACAGUGGAAAGAGgt-3'<br>3'-AUUUCUAUUCCUUGUCACCUUUCUCCA-5'<br>5'-TAAAGATAAGGAACAGTGGAAAGAGGT-3' | (SEQ ID NO: 1867)<br>(SEQ ID NO: 3881)<br>(SEQ ID NO: 5895) |
| LDHA-962 Target: | 5'-AGAUAAGGAACAGUGGAAAGAGGtt-3'<br>3'-UUUCUAUUCCUUGUCACCUUUCUCCAA-5'<br>5'-AAAGATAAGGAACAGTGGAAAGAGGTT-3' | (SEQ ID NO: 1868)<br>(SEQ ID NO: 3882)<br>(SEQ ID NO: 5896) |
| LDHA-963 Target: | 5'-GAUAAGGAACAGUGGAAAGAGGUtc-3'<br>3'-UUCUAUUCCUUGUCACCUUUCUCCAAG-5'<br>5'-AAGATAAGGAACAGTGGAAAGAGGTTC-3' | (SEQ ID NO: 1869)<br>(SEQ ID NO: 3883)<br>(SEQ ID NO: 5897) |
| LDHA-964 Target: | 5'-AUAAGGAACAGUGGAAAGAGGUUca-3'<br>3'-UCUAUUCCUUGUCACCUUUCUCCAAGU-5'<br>5'-AGATAAGGAACAGTGGAAAGAGGTTCA-3' | (SEQ ID NO: 1870)<br>(SEQ ID NO: 3884)<br>(SEQ ID NO: 5898) |
| LDHA-965 Target: | 5'-UAAGGAACAGUGGAAAGAGGUUCac-3'<br>3'-CUAUUCCUUGUCACCUUUCUCCAAGUG-5'<br>5'-GATAAGGAACAGTGGAAAGAGGTTCAC-3' | (SEQ ID NO: 1871)<br>(SEQ ID NO: 3885)<br>(SEQ ID NO: 5899) |
| LDHA-966 Target: | 5'-AAGGAACAGUGGAAAGAGGUUCAca-3'<br>3'-UAUUCCUUGUCACCUUUCUCCAAGUGU-5'<br>5'-ATAAGGAACAGTGGAAAGAGGTTCACA-3' | (SEQ ID NO: 1872)<br>(SEQ ID NO: 3886)<br>(SEQ ID NO: 5900) |
| LDHA-967 Target: | 5'-AGGAACAGUGGAAAGAGGUUCACaa-3'<br>3'-AUUCCUUGUCACCUUUCUCCAAGUGUU-5'<br>5'-TAAGGAACAGTGGAAAGAGGTTCACAA-3' | (SEQ ID NO: 1873)<br>(SEQ ID NO: 3887)<br>(SEQ ID NO: 5901) |
| LDHA-968 Target: | 5'-GGAACAGUGGAAAGAGGUUCACAag-3'<br>3'-UUCCUUGUCACCUUUCUCCAAGUGUUC-5'<br>5'-AAGGAACAGTGGAAAGAGGTTCACAAG-3' | (SEQ ID NO: 1874)<br>(SEQ ID NO: 3888)<br>(SEQ ID NO: 5902) |
| LDHA-969 Target: | 5'-GAACAGUGGAAAGAGGUUCACAAgc-3'<br>3'-UCCUUGUCACCUUUCUCCAAGUGUUCG-5'<br>5'-AGGAACAGTGGAAAGAGGTTCACAAGC-3' | (SEQ ID NO: 1875)<br>(SEQ ID NO: 3889)<br>(SEQ ID NO: 5903) |
| LDHA-970 Target: | 5'-AACAGUGGAAAGAGGUUCACAAGca-3'<br>3'-CCUUGUCACCUUUCUCCAAGUGUUCGU-5'<br>5'-GGAACAGTGGAAAGAGGTTCACAAGCA-3' | (SEQ ID NO: 1876)<br>(SEQ ID NO: 3890)<br>(SEQ ID NO: 5904) |
| LDHA-971 Target: | 5'-ACAGUGGAAAGAGGUUCACAAGCag-3'<br>3'-CUUGUCACCUUUCUCCAAGUGUUCGUC-5'<br>5'-GAACAGTGGAAAGAGGTTCACAAGCAG-3' | (SEQ ID NO: 1877)<br>(SEQ ID NO: 3891)<br>(SEQ ID NO: 5905) |
| LDHA-972 Target: | 5'-CAGUGGAAAGAGGUUCACAAGCAgg-3'<br>3'-UUGUCACCUUUCUCCAAGUGUUCGUCC-5'<br>5'-AACAGTGGAAAGAGGTTCACAAGCAGG-3' | (SEQ ID NO: 1878)<br>(SEQ ID NO: 3892)<br>(SEQ ID NO: 5906) |

TABLE 12-continued

Additional Selected Human Anti-Lactate Dehydrogenase DsiRNA
Agents (Asymmetrics)

|  |  |  |
|---|---|---|
| LDHA-973 Target: | 5'-AGUGGAAAGAGGUUCACAAGCAGgt-3'<br>3'-UGUCACCUUUCUCCAAGUGUUCGUCCA-5'<br>5'-ACAGTGGAAAGAGGTTCACAAGCAGGT-3' | (SEQ ID NO: 1879)<br>(SEQ ID NO: 3893)<br>(SEQ ID NO: 5907) |
| LDHA-974 Target: | 5'-GUGGAAAGAGGUUCACAAGCAGGtg-3'<br>3'-GUCACCUUUCUCCAAGUGUUCGUCCAC-5'<br>5'-CAGTGGAAAGAGGTTCACAAGCAGGTG-3' | (SEQ ID NO: 1880)<br>(SEQ ID NO: 3894)<br>(SEQ ID NO: 5908) |
| LDHA-975 Target: | 5'-UGGAAAGAGGUUCACAAGCAGGUgg-3'<br>3'-UCACCUUUCUCCAAGUGUUCGUCCACC-5'<br>5'-AGTGGAAAGAGGTTCACAAGCAGGTGG-3' | (SEQ ID NO: 1881)<br>(SEQ ID NO: 3895)<br>(SEQ ID NO: 5909) |
| LDHA-976 Target: | 5'-GGAAAGAGGUUCACAAGCAGGUGgt-3'<br>3'-CACCUUUCUCCAAGUGUUCGUCCACCA-5'<br>5'-GTGGAAAGAGGTTCACAAGCAGGTGGT-3' | (SEQ ID NO: 1882)<br>(SEQ ID NO: 3896)<br>(SEQ ID NO: 5910) |
| LDHA-977 Target: | 5'-GAAAGAGGUUCACAAGCAGGUGGtt-3'<br>3'-ACCUUUCUCCAAGUGUUCGUCCACCAA-5'<br>5'-TGGAAAGAGGTTCACAAGCAGGTGGTT-3' | (SEQ ID NO: 1883)<br>(SEQ ID NO: 3897)<br>(SEQ ID NO: 5911) |
| LDHA-978 Target: | 5'-AAAGAGGUUCACAAGCAGGUGGUtg-3'<br>3'-CCUUUCUCCAAGUGUUCGUCCACCAAC-5'<br>5'-GGAAAGAGGTTCACAAGCAGGTGGTTG-3' | (SEQ ID NO: 1884)<br>(SEQ ID NO: 3898)<br>(SEQ ID NO: 5912) |
| LDHA-979 Target: | 5'-AAGAGGUUCACAAGCAGGUGGUUga-3'<br>3'-CUUUCUCCAAGUGUUCGUCCACCAACU-5'<br>5'-GAAAGAGGTTCACAAGCAGGTGGTTGA-3' | (SEQ ID NO: 1885)<br>(SEQ ID NO: 3899)<br>(SEQ ID NO: 5913) |
| LDHA-980 Target: | 5'-AGAGGUUCACAAGCAGGUGGUUGag-3'<br>3'-UUUCUCCAAGUGUUCGUCCACCAACUC-5'<br>5'-AAAGAGGTTCACAAGCAGGTGGTTGAG-3' | (SEQ ID NO: 1886)<br>(SEQ ID NO: 3900)<br>(SEQ ID NO: 5914) |
| LDHA-981 Target: | 5'-GAGGUUCACAAGCAGGUGGUUGAga-3'<br>3'-UUCUCCAAGUGUUCGUCCACCAACUCU-5'<br>5'-AAGAGGTTCACAAGCAGGTGGTTGAGA-3' | (SEQ ID NO: 1887)<br>(SEQ ID NO: 3901)<br>(SEQ ID NO: 5915) |
| LDHA-982 Target: | 5'-AGGUUCACAAGCAGGUGGUUGAGag-3'<br>3'-UCUCCAAGUGUUCGUCCACCAACUCUC-5'<br>5'-AGAGGTTCACAAGCAGGTGGTTGAGAG-3' | (SEQ ID NO: 1888)<br>(SEQ ID NO: 3902)<br>(SEQ ID NO: 5916) |
| LDHA-983 Target: | 5'-GGUUCACAAGCAGGUGGUUGAGAgt-3'<br>3'-CUCCAAGUGUUCGUCCACCAACUCUCA-5'<br>5'-GAGGTTCACAAGCAGGTGGTTGAGAGT-3' | (SEQ ID NO: 1889)<br>(SEQ ID NO: 3903)<br>(SEQ ID NO: 5917) |
| LDHA-984 Target: | 5'-GUUCACAAGCAGGUGGUUGAGAGtg-3'<br>3'-UCCAAGUGUUCGUCCACCAACUCUCAC-5'<br>5'-AGGTTCACAAGCAGGTGGTTGAGAGTG-3' | (SEQ ID NO: 1890)<br>(SEQ ID NO: 3904)<br>(SEQ ID NO: 5918) |
| LDHA-985 Target: | 5'-UUCACAAGCAGGUGGUUGAGAGUgc-3'<br>3'-CCAAGUGUUCGUCCACCAACUCUCACG-5'<br>5'-GGTTCACAAGCAGGTGGTTGAGAGTGC-3' | (SEQ ID NO: 1891)<br>(SEQ ID NO: 3905)<br>(SEQ ID NO: 5919) |
| LDHA-986 Target: | 5'-UCACAAGCAGGUGGUUGAGAGUGct-3'<br>3'-CAAGUGUUCGUCCACCAACUCUCACGA-5'<br>5'-GTTCACAAGCAGGTGGTTGAGAGTGCT-3' | (SEQ ID NO: 1892)<br>(SEQ ID NO: 3906)<br>(SEQ ID NO: 5920) |
| LDHA-987 Target: | 5'-CACAAGCAGGUGGUUGAGAGUGCtt-3'<br>3'-AAGUGUUCGUCCACCAACUCUCACGAA-5'<br>5'-TTCACAAGCAGGTGGTTGAGAGTGCTT-3' | (SEQ ID NO: 1893)<br>(SEQ ID NO: 3907)<br>(SEQ ID NO: 5921) |
| LDHA-988 Target: | 5'-ACAAGCAGGUGGUUGAGAGUGCUta-3'<br>3'-AGUGUUCGUCCACCAACUCUCACGAAU-5'<br>5'-TCACAAGCAGGTGGTTGAGAGTGCTTA-3' | (SEQ ID NO: 1894)<br>(SEQ ID NO: 3908)<br>(SEQ ID NO: 5922) |
| LDHA-989 Target: | 5'-CAAGCAGGUGGUUGAGAGUGCUUat-3'<br>3'-GUGUUCGUCCACCAACUCUCACGAAUA-5'<br>5'-CACAAGCAGGTGGTTGAGAGTGCTTAT-3' | (SEQ ID NO: 1895)<br>(SEQ ID NO: 3909)<br>(SEQ ID NO: 5923) |
| LDHA-990 Target: | 5'-AAGCAGGUGGUUGAGAGUGCUUAtg-3'<br>3'-UGUUCGUCCACCAACUCUCACGAAUAC-5'<br>5'-ACAAGCAGGTGGTTGAGAGTGCTTATG-3' | (SEQ ID NO: 1896)<br>(SEQ ID NO: 3910)<br>(SEQ ID NO: 5924) |
| LDHA-991 Target: | 5'-AGCAGGUGGUUGAGAGUGCUUAUga-3'<br>3'-GUUCGUCCACCAACUCUCACGAAUACU-5'<br>5'-CAAGCAGGTGGTTGAGAGTGCTTATGA-3' | (SEQ ID NO: 1897)<br>(SEQ ID NO: 3911)<br>(SEQ ID NO: 5925) |

TABLE 12-continued

Additional Selected Human Anti-Lactate Dehydrogenase DsiRNA Agents (Asymmetrics)

```
                5'-GCAGGUGGUUGAGAGUGCUUAUGag-3'      (SEQ ID NO: 1898)
                3'-UUCGUCCACCAACUCUCACGAAUACUC-5'    (SEQ ID NO: 3912)
LDHA-992 Target: 5'-AAGCAGGTGGTTGAGAGTGCTTATGAG-3'   (SEQ ID NO: 5926)

5'-CAGGUGGUUGAGAGUGCUUAUGAgg-3'      (SEQ ID NO: 1899)
                3'-UCGUCCACCAACUCUCACGAAUACUCC-5'    (SEQ ID NO: 3913)
LDHA-993 Target: 5'-AGCAGGTGGTTGAGAGTGCTTATGAGG-3'   (SEQ ID NO: 5927)

5'-AGGUGGUUGAGAGUGCUUAUGAGgt-3'      (SEQ ID NO: 1900)
                3'-CGUCCACCAACUCUCACGAAUACUCCA-5'    (SEQ ID NO: 3914)
LDHA-994 Target: 5'-GCAGGTGGTTGAGAGTGCTTATGAGGT-3'   (SEQ ID NO: 5928)

5'-GGUGGUUGAGAGUGCUUAUGAGGtg-3'      (SEQ ID NO: 1901)
                3'-GUCCACCAACUCUCACGAAUACUCCAC-5'    (SEQ ID NO: 3915)
LDHA-995 Target: 5'-CAGGTGGTTGAGAGTGCTTATGAGGTG-3'   (SEQ ID NO: 5929)

5'-GUGGUUGAGAGUGCUUAUGAGGUga-3'      (SEQ ID NO: 1902)
                3'-UCCACCAACUCUCACGAAUACUCCACU-5'    (SEQ ID NO: 3916)
LDHA-996 Target: 5'-AGGTGGTTGAGAGTGCTTATGAGGTGA-3'   (SEQ ID NO: 5930)

5'-UGGUUGAGAGUGCUUAUGAGGUGat-3'      (SEQ ID NO: 1903)
                3'-CCACCAACUCUCACGAAUACUCCACUA-5'    (SEQ ID NO: 3917)
LDHA-997 Target: 5'-GGTGGTTGAGAGTGCTTATGAGGTGAT-3'   (SEQ ID NO: 5931)

5'-GGUUGAGAGUGCUUAUGAGGUGAtc-3'      (SEQ ID NO: 1904)
                3'-CACCAACUCUCACGAAUACUCCACUAG-5'    (SEQ ID NO: 3918)
LDHA-998 Target: 5'-GTGGTTGAGAGTGCTTATGAGGTGATC-3'   (SEQ ID NO: 5932)

5'-GUUGAGAGUGCUUAUGAGGUGAUca-3'      (SEQ ID NO: 1905)
                3'-ACCAACUCUCACGAAUACUCCACUAGU-5'    (SEQ ID NO: 3919)
LDHA-999 Target: 5'-TGGTTGAGAGTGCTTATGAGGTGATCA-3'   (SEQ ID NO: 5933)

5'-UUGAGAGUGCUUAUGAGGUGAUCaa-3'     (SEQ ID NO: 1906)
                 3'-CCAACUCUCACGAAUACUCCACUAGUU-5'   (SEQ ID NO: 3920)
LDHA-1000 Target: 5'-GGTTGAGAGTGCTTATGAGGTGATCAA-3'  (SEQ ID NO: 5934)

5'-UGAGAGUGCUUAUGAGGUGAUCAaa-3'     (SEQ ID NO: 1907)
                 3'-CAACUCUCACGAAUACUCCACUAGUUU-5'   (SEQ ID NO: 3921)
LDHA-1001 Target: 5'-GTTGAGAGTGCTTATGAGGTGATCAAA-3'  (SEQ ID NO: 5935)

5'-GAGAGUGCUUAUGAGGUGAUCAAac-3'     (SEQ ID NO: 1908)
                 3'-AACUCUCACGAAUACUCCACUAGUUUG-5'   (SEQ ID NO: 3922)
LDHA-1002 Target: 5'-TTGAGAGTGCTTATGAGGTGATCAAAC-3'  (SEQ ID NO: 5936)

5'-AGAGUGCUUAUGAGGUGAUCAAACt-3'     (SEQ ID NO: 1909)
                 3'-ACUCUCACGAAUACUCCACUAGUUUGA-5'   (SEQ ID NO: 3923)
LDHA-1003 Target: 5'-TGAGAGTGCTTATGAGGTGATCAAACT-3'  (SEQ ID NO: 5937)

5'-GAGUGCUUAUGAGGUGAUCAAACtc-3'     (SEQ ID NO: 1910)
                 3'-CUCUCACGAAUACUCCACUAGUUUGAG-5'   (SEQ ID NO: 3924)
LDHA-1004 Target: 5'-GAGAGTGCTTATGAGGTGATCAAACTC-3'  (SEQ ID NO: 5938)

5'-AGUGCUUAUGAGGUGAUCAAACUca-3'     (SEQ ID NO: 1911)
                 3'-UCUCACGAAUACUCCACUAGUUUGAGU-5'   (SEQ ID NO: 3925)
LDHA-1005 Target: 5'-AGAGTGCTTATGAGGTGATCAAACTCA-3'  (SEQ ID NO: 5939)

5'-GUGCUUAUGAGGUGAUCAAACUCaa-3'     (SEQ ID NO: 1912)
                 3'-CUCACGAAUACUCCACUAGUUUGAGUU-5'   (SEQ ID NO: 3926)
LDHA-1006 Target: 5'-GAGTGCTTATGAGGTGATCAAACTCAA-3'  (SEQ ID NO: 5940)

5'-UGCUUAUGAGGUGAUCAAACUCAaa-3'     (SEQ ID NO: 1913)
                 3'-UCACGAAUACUCCACUAGUUUGAGUUU-5'   (SEQ ID NO: 3927)
LDHA-1007 Target: 5'-AGTGCTTATGAGGTGATCAAACTCAAA-3'  (SEQ ID NO: 5941)

5'-GCUUAUGAGGUGAUCAAACUCAAag-3'     (SEQ ID NO: 1914)
                 3'-CACGAAUACUCCACUAGUUUGAGUUUC-5'   (SEQ ID NO: 3928)
LDHA-1008 Target: 5'-GTGCTTATGAGGTGATCAAACTCAAAG-3'  (SEQ ID NO: 5942)

5'-CUUAUGAGGUGAUCAAACUCAAAgg-3'     (SEQ ID NO: 1915)
                 3'-ACGAAUACUCCACUAGUUUGAGUUUCC-5'   (SEQ ID NO: 3929)
LDHA-1009 Target: 5'-TGCTTATGAGGTGATCAAACTCAAAGG-3'  (SEQ ID NO: 5943)

5'-UUAUGAGGUGAUCAAACUCAAAGgc-3'     (SEQ ID NO: 1916)
                 3'-CGAAUACUCCACUAGUUUGAGUUUCCG-5'   (SEQ ID NO: 3930)
LDHA-1010 Target: 5'-GCTTATGAGGTGATCAAACTCAAAGGC-3'  (SEQ ID NO: 5944)
```

TABLE 12-continued

Additional Selected Human Anti-Lactate Dehydrogenase DsiRNA Agents (Asymmetrics)

| | | |
|---|---|---|
| LDHA-1011 Target: | 5'-UAUGAGGUGAUCAAACUCAAAGGct-3'<br>3'-GAAUACUCCACUAGUUUGAGUUUCCGA-5'<br>5'-CTTATGAGGTGATCAAACTCAAAGGCT-3' | (SEQ ID NO: 1917)<br>(SEQ ID NO: 3931)<br>(SEQ ID NO: 5945) |
| LDHA-1012 Target: | 5'-AUGAGGUGAUCAAACUCAAAGGCta-3'<br>3'-AAUACUCCACUAGUUUGAGUUUCCGAU-5'<br>5'-TTATGAGGTGATCAAACTCAAAGGCTA-3' | (SEQ ID NO: 1918)<br>(SEQ ID NO: 3932)<br>(SEQ ID NO: 5946) |
| LDHA-1013 Target: | 5'-UGAGGUGAUCAAACUCAAAGGCUac-3'<br>3'-AUACUCCACUAGUUUGAGUUUCCGAUG-5'<br>5'-TATGAGGTGATCAAACTCAAAGGCTAC-3' | (SEQ ID NO: 1919)<br>(SEQ ID NO: 3933)<br>(SEQ ID NO: 5947) |
| LDHA-1014 Target: | 5'-GAGGUGAUCAAACUCAAAGGCUAca-3'<br>3'-UACUCCACUAGUUUGAGUUUCCGAUGU-5'<br>5'-ATGAGGTGATCAAACTCAAAGGCTACA-3' | (SEQ ID NO: 1920)<br>(SEQ ID NO: 3934)<br>(SEQ ID NO: 5948) |
| LDHA-1015 Target: | 5'-AGGUGAUCAAACUCAAAGGCUACac-3'<br>3'-ACUCCACUAGUUUGAGUUUCCGAUGUG-5'<br>5'-TGAGGTGATCAAACTCAAAGGCTACAC-3' | (SEQ ID NO: 1921)<br>(SEQ ID NO: 3935)<br>(SEQ ID NO: 5949) |
| LDHA-1016 Target: | 5'-GGUGAUCAAACUCAAAGGCUACAca-3'<br>3'-CUCCACUAGUUUGAGUUUCCGAUGUGU-5'<br>5'-GAGGTGATCAAACTCAAAGGCTACACA-3' | (SEQ ID NO: 1922)<br>(SEQ ID NO: 3936)<br>(SEQ ID NO: 5950) |
| LDHA-1017 Target: | 5'-GUGAUCAAACUCAAAGGCUACACat-3'<br>3'-UCCACUAGUUUGAGUUUCCGAUGUGUA-5'<br>5'-AGGTGATCAAACTCAAAGGCTACACAT-3' | (SEQ ID NO: 1923)<br>(SEQ ID NO: 3937)<br>(SEQ ID NO: 5951) |
| LDHA-1018 Target: | 5'-UGAUCAAACUCAAAGGCUACACAtc-3'<br>3'-CCACUAGUUUGAGUUUCCGAUGUGUAG-5'<br>5'-GGTGATCAAACTCAAAGGCTACACATC-3' | (SEQ ID NO: 1924)<br>(SEQ ID NO: 3938)<br>(SEQ ID NO: 5952) |
| LDHA-1019 Target: | 5'-GAUCAAACUCAAAGGCUACACAUcc-3'<br>3'-CACUAGUUUGAGUUUCCGAUGUGUAGG-5'<br>5'-GTGATCAAACTCAAAGGCTACACATCC-3' | (SEQ ID NO: 1925)<br>(SEQ ID NO: 3939)<br>(SEQ ID NO: 5953) |
| LDHA-1020 Target: | 5'-AUCAAACUCAAAGGCUACACAUCct-3'<br>3'-ACUAGUUUGAGUUUCCGAUGUGUAGGA-5'<br>5'-TGATCAAACTCAAAGGCTACACATCCT-3' | (SEQ ID NO: 1926)<br>(SEQ ID NO: 3940)<br>(SEQ ID NO: 5954) |
| LDHA-1021 Target: | 5'-UCAAACUCAAAGGCUACACAUCCtg-3'<br>3'-CUAGUUUGAGUUUCCGAUGUGUAGGAC-5'<br>5'-GATCAAACTCAAAGGCTACACATCCTG-3' | (SEQ ID NO: 1927)<br>(SEQ ID NO: 3941)<br>(SEQ ID NO: 5955) |
| LDHA-1022 Target: | 5'-CAAACUCAAAGGCUACACAUCCUgg-3'<br>3'-UAGUUUGAGUUUCCGAUGUGUAGGACC-5'<br>5'-ATCAAACTCAAAGGCTACACATCCTGG-3' | (SEQ ID NO: 1928)<br>(SEQ ID NO: 3942)<br>(SEQ ID NO: 5956) |
| LDHA-1023 Target: | 5'-AAACUCAAAGGCUACACAUCCUGgg-3'<br>3'-AGUUUGAGUUUCCGAUGUGUAGGACCC-5'<br>5'-TCAAACTCAAAGGCTACACATCCTGGG-3' | (SEQ ID NO: 1929)<br>(SEQ ID NO: 3943)<br>(SEQ ID NO: 5957) |
| LDHA-1024 Target: | 5'-AACUCAAAGGCUACACAUCCUGGgc-3'<br>3'-GUUUGAGUUUCCGAUGUGUAGGACCCG-5'<br>5'-CAAACTCAAAGGCTACACATCCTGGGC-3' | (SEQ ID NO: 1930)<br>(SEQ ID NO: 3944)<br>(SEQ ID NO: 5958) |
| LDHA-1025 Target: | 5'-ACUCAAAGGCUACACAUCCUGGGct-3'<br>3'-UUUGAGUUUCCGAUGUGUAGGACCCGA-5'<br>5'-AAACTCAAAGGCTACACATCCTGGGCT-3' | (SEQ ID NO: 1931)<br>(SEQ ID NO: 3945)<br>(SEQ ID NO: 5959) |
| LDHA-1026 Target: | 5'-CUCAAAGGCUACACAUCCUGGGCta-3'<br>3'-UUGAGUUUCCGAUGUGUAGGACCCGAU-5'<br>5'-AACTCAAAGGCTACACATCCTGGGCTA-3' | (SEQ ID NO: 1932)<br>(SEQ ID NO: 3946)<br>(SEQ ID NO: 5960) |
| LDHA-1027 Target: | 5'-UCAAAGGCUACACAUCCUGGGCUat-3'<br>3'-UGAGUUUCCGAUGUGUAGGACCCGAUA-5'<br>5'-ACTCAAAGGCTACACATCCTGGGCTAT-3' | (SEQ ID NO: 1933)<br>(SEQ ID NO: 3947)<br>(SEQ ID NO: 5961) |
| LDHA-1028 Target: | 5'-CAAAGGCUACACAUCCUGGGCUAtt-3'<br>3'-GAGUUUCCGAUGUGUAGGACCCGAUAA-5'<br>5'-CTCAAAGGCTACACATCCTGGGCTATT-3' | (SEQ ID NO: 1934)<br>(SEQ ID NO: 3948)<br>(SEQ ID NO: 5962) |
| LDHA-1029 Target: | 5'-AAAGGCUACACAUCCUGGGCUAUtg-3'<br>3'-AGUUUCCGAUGUGUAGGACCCGAUAAC-5'<br>5'-TCAAAGGCTACACATCCTGGGCTATTG-3' | (SEQ ID NO: 1935)<br>(SEQ ID NO: 3949)<br>(SEQ ID NO: 5963) |

TABLE 12-continued

Additional Selected Human Anti-Lactate Dehydrogenase DsiRNA Agents (Asymmetrics)

|  |  |  |
|---|---|---|
| LDHA-1030 | 5'-AAGGCUACACAUCCUGGGCUAUUgg-3'<br>3'-GUUUCCGAUGUGUAGGACCCGAUAACC-5'<br>Target: 5'-CAAAGGCTACACATCCTGGGCTATTGG-3' | (SEQ ID NO: 1936)<br>(SEQ ID NO: 3950)<br>(SEQ ID NO: 5964) |
| LDHA-1031 | 5'-AGGCUACACAUCCUGGGCUAUUGga-3'<br>3'-UUUCCGAUGUGUAGGACCCGAUAACCU-5'<br>Target: 5'-AAAGGCTACACATCCTGGGCTATTGGA-3' | (SEQ ID NO: 1937)<br>(SEQ ID NO: 3951)<br>(SEQ ID NO: 5965) |
| LDHA-1032 | 5'-GGCUACACAUCCUGGGCUAUUGGac-3'<br>3'-UUCCGAUGUGUAGGACCCGAUAACCUG-5'<br>Target: 5'-AAGGCTACACATCCTGGGCTATTGGAC-3' | (SEQ ID NO: 1938)<br>(SEQ ID NO: 3952)<br>(SEQ ID NO: 5966) |
| LDHA-1033 | 5'-GCUACACAUCCUGGGCUAUUGGAct-3'<br>3'-UCCGAUGUGUAGGACCCGAUAACCUGA-5'<br>Target: 5'-AGGCTACACATCCTGGGCTATTGGACT-3' | (SEQ ID NO: 1939)<br>(SEQ ID NO: 3953)<br>(SEQ ID NO: 5967) |
| LDHA-1034 | 5'-CUACACAUCCUGGGCUAUUGGACtc-3'<br>3'-CCGAUGUGUAGGACCCGAUAACCUGAG-5'<br>Target: 5'-GGCTACACATCCTGGGCTATTGGACTC-3' | (SEQ ID NO: 1940)<br>(SEQ ID NO: 3954)<br>(SEQ ID NO: 5968) |
| LDHA-1035 | 5'-UACACAUCCUGGGCUAUUGGACUct-3'<br>3'-CGAUGUGUAGGACCCGAUAACCUGAGA-5'<br>Target: 5'-GCTACACATCCTGGGCTATTGGACTCT-3' | (SEQ ID NO: 1941)<br>(SEQ ID NO: 3955)<br>(SEQ ID NO: 5969) |
| LDHA-1036 | 5'-ACACAUCCUGGGCUAUUGGACUCtc-3'<br>3'-GAUGUGUAGGACCCGAUAACCUGAGAG-5'<br>Target: 5'-CTACACATCCTGGGCTATTGGACTCTC-3' | (SEQ ID NO: 1942)<br>(SEQ ID NO: 3956)<br>(SEQ ID NO: 5970) |
| LDHA-1037 | 5'-CACAUCCUGGGCUAUUGGACUCUct-3'<br>3'-AUGUGUAGGACCCGAUAACCUGAGAGA-5'<br>Target: 5'-TACACATCCTGGGCTATTGGACTCTCT-3' | (SEQ ID NO: 1943)<br>(SEQ ID NO: 3957)<br>(SEQ ID NO: 5971) |
| LDHA-1038 | 5'-ACAUCCUGGGCUAUUGGACUCUCtg-3'<br>3'-UGUGUAGGACCCGAUAACCUGAGAGAC-5'<br>Target: 5'-ACACATCCTGGGCTATTGGACTCTCTG-3' | (SEQ ID NO: 1944)<br>(SEQ ID NO: 3958)<br>(SEQ ID NO: 5972) |
| LDHA-1039 | 5'-CAUCCUGGGCUAUUGGACUCUCUgt-3'<br>3'-GUGUAGGACCCGAUAACCUGAGAGACA-5'<br>Target: 5'-CACATCCTGGGCTATTGGACTCTCTGT-3' | (SEQ ID NO: 1945)<br>(SEQ ID NO: 3959)<br>(SEQ ID NO: 5973) |
| LDHA-1040 | 5'-AUCCUGGGCUAUUGGACUCUCUGta-3'<br>3'-UGUAGGACCCGAUAACCUGAGAGACAU-5'<br>Target: 5'-ACATCCTGGGCTATTGGACTCTCTGTA-3' | (SEQ ID NO: 1946)<br>(SEQ ID NO: 3960)<br>(SEQ ID NO: 5974) |
| LDHA-1041 | 5'-UCCUGGGCUAUUGGACUCUCUGUag-3'<br>3'-GUAGGACCCGAUAACCUGAGAGACAUC-5'<br>Target: 5'-CATCCTGGGCTATTGGACTCTCTGTAG-3' | (SEQ ID NO: 1947)<br>(SEQ ID NO: 3961)<br>(SEQ ID NO: 5975) |
| LDHA-1042 | 5'-CCUGGGCUAUUGGACUCUCUGUAgc-3'<br>3'-UAGGACCCGAUAACCUGAGAGACAUCG-5'<br>Target: 5'-ATCCTGGGCTATTGGACTCTCTGTAGC-3' | (SEQ ID NO: 1948)<br>(SEQ ID NO: 3962)<br>(SEQ ID NO: 5976) |
| LDHA-1043 | 5'-CUGGGCUAUUGGACUCUCUGUAGca-3'<br>3'-AGGACCCGAUAACCUGAGAGACAUCGU-5'<br>Target: 5'-TCCTGGGCTATTGGACTCTCTGTAGCA-3' | (SEQ ID NO: 1949)<br>(SEQ ID NO: 3963)<br>(SEQ ID NO: 5977) |
| LDHA-1044 | 5'-UGGGCUAUUGGACUCUCUGUAGCag-3'<br>3'-GGACCCGAUAACCUGAGAGACAUCGUC-5'<br>Target: 5'-CCTGGGCTATTGGACTCTCTGTAGCAG-3' | (SEQ ID NO: 1950)<br>(SEQ ID NO: 3964)<br>(SEQ ID NO: 5978) |
| LDHA-1045 | 5'-GGGCUAUUGGACUCUCUGUAGCAga-3'<br>3'-GACCCGAUAACCUGAGAGACAUCGUCU-5'<br>Target: 5'-CTGGGCTATTGGACTCTCTGTAGCAGA-3' | (SEQ ID NO: 1951)<br>(SEQ ID NO: 3965)<br>(SEQ ID NO: 5979) |
| LDHA-1046 | 5'-GGCUAUUGGACUCUCUGUAGCAGat-3'<br>3'-ACCCGAUAACCUGAGAGACAUCGUCUA-5'<br>Target: 5'-TGGGCTATTGGACTCTCTGTAGCAGAT-3' | (SEQ ID NO: 1952)<br>(SEQ ID NO: 3966)<br>(SEQ ID NO: 5980) |
| LDHA-1047 | 5'-GCUAUUGGACUCUCUGUAGCAGAtt-3'<br>3'-CCCGAUAACCUGAGAGACAUCGUCUAA-5'<br>Target: 5'-GGGCTATTGGACTCTCTGTAGCAGATT-3' | (SEQ ID NO: 1953)<br>(SEQ ID NO: 3967)<br>(SEQ ID NO: 5981) |
| LDHA-1048 | 5'-CUAUUGGACUCUCUGUAGCAGAUtt-3'<br>3'-CCGAUAACCUGAGAGACAUCGUCUAAA-5'<br>Target: 5'-GGCTATTGGACTCTCTGTAGCAGATTT-3' | (SEQ ID NO: 1954)<br>(SEQ ID NO: 3968)<br>(SEQ ID NO: 5982) |

TABLE 12-continued

Additional Selected Human Anti-Lactate Dehydrogenase DsiRNA Agents (Asymmetrics)

```
                5'-UAUUGGACUCUCUGUAGCAGAUUtg-3'    (SEQ ID NO: 1955)
                3'-CGAUAACCUGAGAGACAUCGUCUAAAC-5'  (SEQ ID NO: 3969)
LDHA-1049 Target: 5'-GCTATTGGACTCTCTGTAGCAGATTTG-3'  (SEQ ID NO: 5983)

5'-AUUGGACUCUCUGUAGCAGAUUUgg-3'    (SEQ ID NO: 1956)
                3'-GAUAACCUGAGAGACAUCGUCUAAACC-5'  (SEQ ID NO: 3970)
LDHA-1050 Target: 5'-CTATTGGACTCTCTGTAGCAGATTTGG-3' (SEQ ID NO: 5984)

5'-UUGGACUCUCUGUAGCAGAUUUGgc-3'    (SEQ ID NO: 1957)
                3'-AUAACCUGAGAGACAUCGUCUAAACCG-5'  (SEQ ID NO: 3971)
LDHA-1051 Target: 5'-TATTGGACTCTCTGTAGCAGATTTGGC-3' (SEQ ID NO: 5985)

5'-UGGACUCUCUGUAGCAGAUUUGGca-3'    (SEQ ID NO: 1958)
                3'-UAACCUGAGAGACAUCGUCUAAACCGU-5'  (SEQ ID NO: 3972)
LDHA-1052 Target: 5'-ATTGGACTCTCTGTAGCAGATTTGGCA-3' (SEQ ID NO: 5986)

5'-GGACUCUCUGUAGCAGAUUUGGCag-3'    (SEQ ID NO: 1959)
                3'-AACCUGAGAGACAUCGUCUAAACCGUC-5'  (SEQ ID NO: 3973)
LDHA-1053 Target: 5'-TTGGACTCTCTGTAGCAGATTTGGCAG-3' (SEQ ID NO: 5987)

5'-GACUCUCUGUAGCAGAUUUGGCAga-3'    (SEQ ID NO: 1960)
                3'-ACCUGAGAGACAUCGUCUAAACCGUCU-5'  (SEQ ID NO: 3974)
LDHA-1054 Target: 5'-TGGACTCTCTGTAGCAGATTTGGCAGA-3' (SEQ ID NO: 5988)

5'-ACUCUCUGUAGCAGAUUUGGCAGag-3'    (SEQ ID NO: 1961)
                3'-CCUGAGAGACAUCGUCUAAACCGUCUC-5'  (SEQ ID NO: 3975)
LDHA-1055 Target: 5'-GGACTCTCTGTAGCAGATTTGGCAGAG-3' (SEQ ID NO: 5989)

5'-CUCUCUGUAGCAGAUUUGGCAGAga-3'    (SEQ ID NO: 1962)
                3'-CUGAGAGACAUCGUCUAAACCGUCUCU-5'  (SEQ ID NO: 3976)
LDHA-1056 Target: 5'-GACTCTCTGTAGCAGATTTGGCAGAGA-3' (SEQ ID NO: 5990)

5'-UCUCUGUAGCAGAUUUGGCAGAGag-3'    (SEQ ID NO: 1963)
                3'-UGAGAGACAUCGUCUAAACCGUCUCUC-5'  (SEQ ID NO: 3977)
LDHA-1057 Target: 5'-ACTCTCTGTAGCAGATTTGGCAGAGAG-3' (SEQ ID NO: 5991)

5'-CUCUGUAGCAGAUUUGGCAGAGAgt-3'    (SEQ ID NO: 1964)
                3'-GAGAGACAUCGUCUAAACCGUCUCUCA-5'  (SEQ ID NO: 3978)
LDHA-1058 Target: 5'-CTCTCTGTAGCAGATTTGGCAGAGAGT-3' (SEQ ID NO: 5992)

5'-UCUGUAGCAGAUUUGGCAGAGAGta-3'    (SEQ ID NO: 1965)
                3'-AGAGACAUCGUCUAAACCGUCUCUCAU-5'  (SEQ ID NO: 3979)
LDHA-1059 Target: 5'-TCTCTGTAGCAGATTTGGCAGAGAGTA-3' (SEQ ID NO: 5993)

5'-CUGUAGCAGAUUUGGCAGAGAGUat-3'    (SEQ ID NO: 1966)
                3'-GAGACAUCGUCUAAACCGUCUCUCAUA-5'  (SEQ ID NO: 3980)
LDHA-1060 Target: 5'-CTCTGTAGCAGATTTGGCAGAGAGTAT-3' (SEQ ID NO: 5994)

5'-UGUAGCAGAUUUGGCAGAGAGUAta-3'    (SEQ ID NO: 1967)
                3'-AGACAUCGUCUAAACCGUCUCUCAUAU-5'  (SEQ ID NO: 3981)
LDHA-1061 Target: 5'-TCTGTAGCAGATTTGGCAGAGAGTATA-3' (SEQ ID NO: 5995)

5'-GUAGCAGAUUUGGCAGAGAGUAUaa-3'    (SEQ ID NO: 1968)
                3'-GACAUCGUCUAAACCGUCUCUCAUAUU-5'  (SEQ ID NO: 3982)
LDHA-1062 Target: 5'-CTGTAGCAGATTTGGCAGAGAGTATAA-3' (SEQ ID NO: 5996)

5'-UAGCAGAUUUGGCAGAGAGUAUAat-3'    (SEQ ID NO: 1969)
                3'-ACAUCGUCUAAACCGUCUCUCAUAUUA-5'  (SEQ ID NO: 3983)
LDHA-1063 Target: 5'-TGTAGCAGATTTGGCAGAGAGTATAAT-3' (SEQ ID NO: 5997)

5'-AGCAGAUUUGGCAGAGAGUAUAAtg-3'    (SEQ ID NO: 1970)
                3'-CAUCGUCUAAACCGUCUCUCAUAUUAC-5'  (SEQ ID NO: 3984)
LDHA-1064 Target: 5'-GTAGCAGATTTGGCAGAGAGTATAATG-3' (SEQ ID NO: 5998)

5'-GCAGAUUUGGCAGAGAGUAUAAUga-3'    (SEQ ID NO: 1971)
                3'-AUCGUCUAAACCGUCUCUCAUAUUACU-5'  (SEQ ID NO: 3985)
LDHA-1065 Target: 5'-TAGCAGATTTGGCAGAGAGTATAATGA-3' (SEQ ID NO: 5999)

5'-CAGAUUUGGCAGAGAGUAUAAUGaa-3'    (SEQ ID NO: 1972)
                3'-UCGUCUAAACCGUCUCUCAUAUUACUU-5'  (SEQ ID NO: 3986)
LDHA-1066 Target: 5'-AGCAGATTTGGCAGAGAGTATAATGAA-3' (SEQ ID NO: 6000)

5'-AGAUUUGGCAGAGAGUAUAAUGAag-3'    (SEQ ID NO: 1973)
                3'-CGUCUAAACCGUCUCUCAUAUUACUUC-5'  (SEQ ID NO: 3987)
LDHA-1067 Target: 5'-GCAGATTTGGCAGAGAGTATAATGAAG-3' (SEQ ID NO: 6001)
```

TABLE 12-continued

Additional Selected Human Anti-Lactate Dehydrogenase DsiRNA Agents (Asymmetrics)

```
                5'-GAUUUGGCAGAGAGUAUAAUGAAga-3'        (SEQ ID NO: 1974)
                3'-GUCUAAACCGUCUCUCAUAUUACUUCU-5'      (SEQ ID NO: 3988)
LDHA-1068 Target: 5'-CAGATTTGGCAGAGAGTATAATGAAGA-3'    (SEQ ID NO: 6002)

5'-AUUUGGCAGAGAGUAUAAUGAAGaa-3'        (SEQ ID NO: 1975)
                3'-UCUAAACCGUCUCUCAUAUUACUUCUU-5'      (SEQ ID NO: 3989)
LDHA-1069 Target: 5'-AGATTTGGCAGAGAGTATAATGAAGAA-3'    (SEQ ID NO: 6003)

5'-UUUGGCAGAGAGUAUAAUGAAGAat-3'        (SEQ ID NO: 1976)
                3'-CUAAACCGUCUCUCAUAUUACUUCUUA-5'      (SEQ ID NO: 3990)
LDHA-1070 Target: 5'-GATTTGGCAGAGAGTATAATGAAGAAT-3'    (SEQ ID NO: 6004)

5'-UUGGCAGAGAGUAUAAUGAAGAAtc-3'        (SEQ ID NO: 1977)
                3'-UAAACCGUCUCUCAUAUUACUUCUUAG-5'      (SEQ ID NO: 3991)
LDHA-1071 Target: 5'-ATTTGGCAGAGAGTATAATGAAGAATC-3'    (SEQ ID NO: 6005)

5'-UGGCAGAGAGUAUAAUGAAGAAUct-3'        (SEQ ID NO: 1978)
                3'-AAACCGUCUCUCAUAUUACUUCUUAGA-5'      (SEQ ID NO: 3992)
LDHA-1072 Target: 5'-TTTGGCAGAGAGTATAATGAAGAATCT-3'    (SEQ ID NO: 6006)

5'-GGCAGAGAGUAUAAUGAAGAAUCtt-3'        (SEQ ID NO: 1979)
                3'-AACCGUCUCUCAUAUUACUUCUUAGAA-5'      (SEQ ID NO: 3993)
LDHA-1073 Target: 5'-TTGGCAGAGAGTATAATGAAGAATCTT-3'    (SEQ ID NO: 6007)

5'-GCAGAGAGUAUAAUGAAGAAUCUta-3'        (SEQ ID NO: 1980)
                3'-ACCGUCUCUCAUAUUACUUCUUAGAAU-5'      (SEQ ID NO: 3994)
LDHA-1074 Target: 5'-TGGCAGAGAGTATAATGAAGAATCTTA-3'    (SEQ ID NO: 6008)

5'-CAGAGAGUAUAAUGAAGAAUCUUag-3'        (SEQ ID NO: 1981)
                3'-CCGUCUCUCAUAUUACUUCUUAGAAUC-5'      (SEQ ID NO: 3995)
LDHA-1075 Target: 5'-GGCAGAGAGTATAATGAAGAATCTTAG-3'    (SEQ ID NO: 6009)

5'-AGAGAGUAUAAUGAAGAAUCUUAgg-3'        (SEQ ID NO: 1982)
                3'-CGUCUCUCAUAUUACUUCUUAGAAUCC-5'      (SEQ ID NO: 3996)
LDHA-1076 Target: 5'-GCAGAGAGTATAATGAAGAATCTTAGG-3'    (SEQ ID NO: 6010)

5'-GAGAGUAUAAUGAAGAAUCUUAGgc-3'        (SEQ ID NO: 1983)
                3'-GUCUCUCAUAUUACUUCUUAGAAUCCG-5'      (SEQ ID NO: 3997)
LDHA-1077 Target: 5'-CAGAGAGTATAATGAAGAATCTTAGGC-3'    (SEQ ID NO: 6011)

5'-AGAGUAUAAUGAAGAAUCUUAGGcg-3'        (SEQ ID NO: 1984)
                3'-UCUCUCAUAUUACUUCUUAGAAUCCGC-5'      (SEQ ID NO: 3998)
LDHA-1078 Target: 5'-AGAGAGTATAATGAAGAATCTTAGGCG-3'    (SEQ ID NO: 6012)

5'-GAGUAUAAUGAAGAAUCUUAGGCgg-3'        (SEQ ID NO: 1985)
                3'-CUCUCAUAUUACUUCUUAGAAUCCGCC-5'      (SEQ ID NO: 3999)
LDHA-1079 Target: 5'-GAGAGTATAATGAAGAATCTTAGGCGG-3'    (SEQ ID NO: 6013)

5'-AGUAUAAUGAAGAAUCUUAGGCGgg-3'        (SEQ ID NO: 1986)
                3'-UCUCAUAUUACUUCUUAGAAUCCGCCC-5'      (SEQ ID NO: 4000)
LDHA-1080 Target: 5'-AGAGTATAATGAAGAATCTTAGGCGGG-3'    (SEQ ID NO: 6014)

5'-GUAUAAUGAAGAAUCUUAGGCGGgt-3'        (SEQ ID NO: 1987)
                3'-CUCAUAUUACUUCUUAGAAUCCGCCCA-5'      (SEQ ID NO: 4001)
LDHA-1081 Target: 5'-GAGTATAATGAAGAATCTTAGGCGGGT-3'    (SEQ ID NO: 6015)

5'-UAUAAUGAAGAAUCUUAGGCGGGtg-3'        (SEQ ID NO: 1988)
                3'-UCAUAUUACUUCUUAGAAUCCGCCCAC-5'      (SEQ ID NO: 4002)
LDHA-1082 Target: 5'-AGTATAATGAAGAATCTTAGGCGGGTG-3'    (SEQ ID NO: 6016)

5'-AUAAUGAAGAAUCUUAGGCGGGUgc-3'        (SEQ ID NO: 1989)
                3'-CAUAUUACUUCUUAGAAUCCGCCCACG-5'      (SEQ ID NO: 4003)
LDHA-1083 Target: 5'-GTATAATGAAGAATCTTAGGCGGGTGC-3'    (SEQ ID NO: 6017)

5'-UAAUGAAGAAUCUUAGGCGGGUGca-3'        (SEQ ID NO: 1990)
                3'-AUAUUACUUCUUAGAAUCCGCCCACGU-5'      (SEQ ID NO: 4004)
LDHA-1084 Target: 5'-TATAATGAAGAATCTTAGGCGGGTGCA-3'    (SEQ ID NO: 6018)

5'-AAUGAAGAAUCUUAGGCGGGUGCac-3'        (SEQ ID NO: 1991)
                3'-UAUUACUUCUUAGAAUCCGCCCACGUG-5'      (SEQ ID NO: 4005)
LDHA-1085 Target: 5'-ATAATGAAGAATCTTAGGCGGGTGCAC-3'    (SEQ ID NO: 6019)

5'-AUGAAGAAUCUUAGGCGGGUGCAcc-3'        (SEQ ID NO: 1992)
                3'-AUUACUUCUUAGAAUCCGCCCACGUGG-5'      (SEQ ID NO: 4006)
LDHA-1086 Target: 5'-TAATGAAGAATCTTAGGCGGGTGCACC-3'    (SEQ ID NO: 6020)
```

TABLE 12-continued

Additional Selected Human Anti-Lactate Dehydrogenase DsiRNA Agents (Asymmetrics)

|               |                                                                                                                                                       |                                                  |
|---------------|-------------------------------------------------------------------------------------------------------------------------------------------------------|--------------------------------------------------|
| LDHA-1087 Target: | 5'-UGAAGAAUCUUAGGCGGGUGCACcc-3'<br>3'-UUACUUCUUAGAAUCCGCCCACGUGGG-5'<br>5'-AATGAAGAATCTTAGGCGGGTGCACCC-3'                                              | (SEQ ID NO: 1993)<br>(SEQ ID NO: 4007)<br>(SEQ ID NO: 6021) |
| LDHA-1088 Target: | 5'-GAAGAAUCUUAGGCGGGUGCACCca-3'<br>3'-UACUUCUUAGAAUCCGCCCACGUGGGU-5'<br>5'-ATGAAGAATCTTAGGCGGGTGCACCCA-3'                                              | (SEQ ID NO: 1994)<br>(SEQ ID NO: 4008)<br>(SEQ ID NO: 6022) |
| LDHA-1089 Target: | 5'-AAGAAUCUUAGGCGGGUGCACCCag-3'<br>3'-ACUUCUUAGAAUCCGCCCACGUGGGUC-5'<br>5'-TGAAGAATCTTAGGCGGGTGCACCCAG-3'                                              | (SEQ ID NO: 1995)<br>(SEQ ID NO: 4009)<br>(SEQ ID NO: 6023) |
| LDHA-1090 Target: | 5'-AGAAUCUUAGGCGGGUGCACCCAgt-3'<br>3'-CUUCUUAGAAUCCGCCCACGUGGGUCA-5'<br>5'-GAAGAATCTTAGGCGGGTGCACCCAGT-3'                                              | (SEQ ID NO: 1996)<br>(SEQ ID NO: 4010)<br>(SEQ ID NO: 6024) |
| LDHA-1091 Target: | 5'-GAAUCUUAGGCGGGUGCACCCAGtt-3'<br>3'-UUCUUAGAAUCCGCCCACGUGGGUCAA-5'<br>5'-AAGAATCTTAGGCGGGTGCACCCAGTT-3'                                              | (SEQ ID NO: 1997)<br>(SEQ ID NO: 4011)<br>(SEQ ID NO: 6025) |
| LDHA-1092 Target: | 5'-AAUCUUAGGCGGGUGCACCCAGUtt-3'<br>3'-UCUUAGAAUCCGCCCACGUGGGUCAAA-5'<br>5'-AGAATCTTAGGCGGGTGCACCCAGTTT-3'                                              | (SEQ ID NO: 1998)<br>(SEQ ID NO: 4012)<br>(SEQ ID NO: 6026) |
| LDHA-1093 Target: | 5'-AUCUUAGGCGGGUGCACCCAGUUtc-3'<br>3'-CUUAGAAUCCGCCCACGUGGGUCAAAG-5'<br>5'-GAATCTTAGGCGGGTGCACCCAGTTTC-3'                                              | (SEQ ID NO: 1999)<br>(SEQ ID NO: 4013)<br>(SEQ ID NO: 6027) |
| LDHA-1094 Target: | 5'-UCUUAGGCGGGUGCACCCAGUUUcc-3'<br>3'-UUAGAAUCCGCCCACGUGGGUCAAAGG-5'<br>5'-AATCTTAGGCGGGTGCACCCAGTTTCC-3'                                              | (SEQ ID NO: 2000)<br>(SEQ ID NO: 4014)<br>(SEQ ID NO: 6028) |
| LDHA-1095 Target: | 5'-CUUAGGCGGGUGCACCCAGUUUCca-3'<br>3'-UAGAAUCCGCCCACGUGGGUCAAAGGU-5'<br>5'-ATCTTAGGCGGGTGCACCCAGTTTCCA-3'                                              | (SEQ ID NO: 2001)<br>(SEQ ID NO: 4015)<br>(SEQ ID NO: 6029) |
| LDHA-1096 Target: | 5'-UUAGGCGGGUGCACCCAGUUUCCac-3'<br>3'-AGAAUCCGCCCACGUGGGUCAAAGGUG-5'<br>5'-TCTTAGGCGGGTGCACCCAGTTTCCAC-3'                                              | (SEQ ID NO: 2002)<br>(SEQ ID NO: 4016)<br>(SEQ ID NO: 6030) |
| LDHA-1097 Target: | 5'-UAGGCGGGUGCACCCAGUUUCCAcc-3'<br>3'-GAAUCCGCCCACGUGGGUCAAAGGUGG-5'<br>5'-CTTAGGCGGGTGCACCCAGTTTCCACC-3'                                              | (SEQ ID NO: 2003)<br>(SEQ ID NO: 4017)<br>(SEQ ID NO: 6031) |
| LDHA-1098 Target: | 5'-AGGCGGGUGCACCCAGUUUCCACca-3'<br>3'-AAUCCGCCCACGUGGGUCAAAGGUGGU-5'<br>5'-TTAGGCGGGTGCACCCAGTTTCCACCA-3'                                              | (SEQ ID NO: 2004)<br>(SEQ ID NO: 4018)<br>(SEQ ID NO: 6032) |
| LDHA-1099 Target: | 5'-GGCGGGUGCACCCAGUUUCCACCat-3'<br>3'-AUCCGCCCACGUGGGUCAAAGGUGGUA-5'<br>5'-TAGGCGGGTGCACCCAGTTTCCACCAT-3'                                              | (SEQ ID NO: 2005)<br>(SEQ ID NO: 4019)<br>(SEQ ID NO: 6033) |
| LDHA-1100 Target: | 5'-GCGGGUGCACCCAGUUUCCACCAtg-3'<br>3'-UCCGCCCACGUGGGUCAAAGGUGGUAC-5'<br>5'-AGGCGGGTGCACCCAGTTTCCACCATG-3'                                              | (SEQ ID NO: 2006)<br>(SEQ ID NO: 4020)<br>(SEQ ID NO: 6034) |
| LDHA-1101 Target: | 5'-CGGGUGCACCCAGUUUCCACCAUga-3'<br>3'-CCGCCCACGUGGGUCAAAGGUGGUACU-5'<br>5'-GGCGGGTGCACCCAGTTTCCACCATGA-3'                                              | (SEQ ID NO: 2007)<br>(SEQ ID NO: 4021)<br>(SEQ ID NO: 6035) |
| LDHA-1102 Target: | 5'-GGGUGCACCCAGUUUCCACCAUGat-3'<br>3'-CGCCCACGUGGGUCAAAGGUGGUACUA-5'<br>5'-GCGGGTGCACCCAGTTTCCACCATGAT-3'                                              | (SEQ ID NO: 2008)<br>(SEQ ID NO: 4022)<br>(SEQ ID NO: 6036) |
| LDHA-1103 Target: | 5'-GGUGCACCCAGUUUCCACCAUGAtt-3'<br>3'-GCCCACGUGGGUCAAAGGUGGUACUAA-5'<br>5'-CGGGTGCACCCAGTTTCCACCATGATT-3'                                              | (SEQ ID NO: 2009)<br>(SEQ ID NO: 4023)<br>(SEQ ID NO: 6037) |
| LDHA-1104 Target: | 5'-GUGCACCCAGUUUCCACCAUGAUta-3'<br>3'-CCCACGUGGGUCAAAGGUGGUACUAAU-5'<br>5'-GGGTGCACCCAGTTTCCACCATGATTA-3'                                              | (SEQ ID NO: 2010)<br>(SEQ ID NO: 4024)<br>(SEQ ID NO: 6038) |
| LDHA-1105 Target: | 5'-UGCACCCAGUUUCCACCAUGAUUaa-3'<br>3'-CCACGUGGGUCAAAGGUGGUACUAAUU-5'<br>5'-GGTGCACCCAGTTTCCACCATGATTAA-3'                                              | (SEQ ID NO: 2011)<br>(SEQ ID NO: 4025)<br>(SEQ ID NO: 6039) |

TABLE 12-continued

Additional Selected Human Anti-Lactate Dehydrogenase DsiRNA Agents (Asymmetrics)

| | | |
|---|---|---|
| LDHA-1106 | 5'-GCACCCAGUUUCCACCAUGAUUAag-3'<br>3'-CACGUGGGUCAAAGGUGGUACUAAUUC-5'<br>Target: 5'-GTGCACCCAGTTTCCACCATGATTAAG-3' | (SEQ ID NO: 2012)<br>(SEQ ID NO: 4026)<br>(SEQ ID NO: 6040) |
| LDHA-1107 | 5'-CACCCAGUUUCCACCAUGAUUAAgg-3'<br>3'-ACGUGGGUCAAAGGUGGUACUAAUUCC-5'<br>Target: 5'-TGCACCCAGTTTCCACCATGATTAAGG-3' | (SEQ ID NO: 2013)<br>(SEQ ID NO: 4027)<br>(SEQ ID NO: 6041) |
| LDHA-1108 | 5'-ACCCAGUUUCCACCAUGAUUAAGgg-3'<br>3'-CGUGGGUCAAAGGUGGUACUAAUUCCC-5'<br>Target: 5'-GCACCCAGTTTCCACCATGATTAAGGG-3' | (SEQ ID NO: 2014)<br>(SEQ ID NO: 4028)<br>(SEQ ID NO: 6042) |
| LDHA-1109 | 5'-CCCAGUUUCCACCAUGAUUAAGGgt-3'<br>3'-GUGGGUCAAAGGUGGUACUAAUUCCCA-5'<br>Target: 5'-CACCCAGTTTCCACCATGATTAAGGGT-3' | (SEQ ID NO: 2015)<br>(SEQ ID NO: 4029)<br>(SEQ ID NO: 6043) |
| LDHA-1110 | 5'-CCAGUUUCCACCAUGAUUAAGGGtc-3'<br>3'-UGGGUCAAAGGUGGUACUAAUUCCCAG-5'<br>Target: 5'-ACCCAGTTTCCACCATGATTAAGGGTC-3' | (SEQ ID NO: 2016)<br>(SEQ ID NO: 4030)<br>(SEQ ID NO: 6044) |
| LDHA-1111 | 5'-CAGUUUCCACCAUGAUUAAGGGUct-3'<br>3'-GGGUCAAAGGUGGUACUAAUUCCCAGA-5'<br>Target: 5'-CCCAGTTTCCACCATGATTAAGGGTCT-3' | (SEQ ID NO: 2017)<br>(SEQ ID NO: 4031)<br>(SEQ ID NO: 6045) |
| LDHA-1112 | 5'-AGUUUCCACCAUGAUUAAGGGUCtt-3'<br>3'-GGUCAAAGGUGGUACUAAUUCCCAGAA-5'<br>Target: 5'-CCAGTTTCCACCATGATTAAGGGTCTT-3' | (SEQ ID NO: 2018)<br>(SEQ ID NO: 4032)<br>(SEQ ID NO: 6046) |
| LDHA-1113 | 5'-GUUUCCACCAUGAUUAAGGGUCUtt-3'<br>3'-GUCAAAGGUGGUACUAAUUCCCAGAAA-5'<br>Target: 5'-CAGTTTCCACCATGATTAAGGGTCTTT-3' | (SEQ ID NO: 2019)<br>(SEQ ID NO: 4033)<br>(SEQ ID NO: 6047) |
| LDHA-1114 | 5'-UUUCCACCAUGAUUAAGGGUCUUta-3'<br>3'-UCAAAGGUGGUACUAAUUCCCAGAAAU-5'<br>Target: 5'-AGTTTCCACCATGATTAAGGGTCTTTA-3' | (SEQ ID NO: 2020)<br>(SEQ ID NO: 4034)<br>(SEQ ID NO: 6048) |
| LDHA-1115 | 5'-UUCCACCAUGAUUAAGGGUCUUUac-3'<br>3'-CAAAGGUGGUACUAAUUCCCAGAAAUG-5'<br>Target: 5'-GTTTCCACCATGATTAAGGGTCTTTAC-3' | (SEQ ID NO: 2021)<br>(SEQ ID NO: 4035)<br>(SEQ ID NO: 6049) |
| LDHA-1116 | 5'-UCCACCAUGAUUAAGGGUCUUUAcg-3'<br>3'-AAAGGUGGUACUAAUUCCCAGAAAUGC-5'<br>Target: 5'-TTTCCACCATGATTAAGGGTCTTTACG-3' | (SEQ ID NO: 2022)<br>(SEQ ID NO: 4036)<br>(SEQ ID NO: 6050) |
| LDHA-1117 | 5'-CCACCAUGAUUAAGGGUCUUUACgg-3'<br>3'-AAGGUGGUACUAAUUCCCAGAAAUGCC-5'<br>Target: 5'-TTCCACCATGATTAAGGGTCTTTACGG-3' | (SEQ ID NO: 2023)<br>(SEQ ID NO: 4037)<br>(SEQ ID NO: 6051) |
| LDHA-1118 | 5'-CACCAUGAUUAAGGGUCUUUACGga-3'<br>3'-AGGUGGUACUAAUUCCCAGAAAUGCCU-5'<br>Target: 5'-TCCACCATGATTAAGGGTCTTTACGGA-3' | (SEQ ID NO: 2024)<br>(SEQ ID NO: 4038)<br>(SEQ ID NO: 6052) |
| LDHA-1119 | 5'-ACCAUGAUUAAGGGUCUUUACGGaa-3'<br>3'-GGUGGUACUAAUUCCCAGAAAUGCCUU-5'<br>Target: 5'-CCACCATGATTAAGGGTCTTTACGGAA-3' | (SEQ ID NO: 2025)<br>(SEQ ID NO: 4039)<br>(SEQ ID NO: 6053) |
| LDHA-1120 | 5'-CCAUGAUUAAGGGUCUUUACGGAat-3'<br>3'-GUGGUACUAAUUCCCAGAAAUGCCUUA-5'<br>Target: 5'-CACCATGATTAAGGGTCTTTACGGAAT-3' | (SEQ ID NO: 2026)<br>(SEQ ID NO: 4040)<br>(SEQ ID NO: 6054) |
| LDHA-1121 | 5'-CAUGAUUAAGGGUCUUUACGGAAta-3'<br>3'-UGGUACUAAUUCCCAGAAAUGCCUUAU-5'<br>Target: 5'-ACCATGATTAAGGGTCTTTACGGAATA-3' | (SEQ ID NO: 2027)<br>(SEQ ID NO: 4041)<br>(SEQ ID NO: 6055) |
| LDHA-1122 | 5'-AUGAUUAAGGGUCUUUACGGAAUaa-3'<br>3'-GGUACUAAUUCCCAGAAAUGCCUUAUU-5'<br>Target: 5'-CCATGATTAAGGGTCTTTACGGAATAA-3' | (SEQ ID NO: 2028)<br>(SEQ ID NO: 4042)<br>(SEQ ID NO: 6056) |
| LDHA-1123 | 5'-UGAUUAAGGGUCUUUACGGAAUAaa-3'<br>3'-GUACUAAUUCCCAGAAAUGCCUUAUUU-5'<br>Target: 5'-CATGATTAAGGGTCTTTACGGAATAAA-3' | (SEQ ID NO: 2029)<br>(SEQ ID NO: 4043)<br>(SEQ ID NO: 6057) |
| LDHA-1124 | 5'-GAUUAAGGGUCUUUACGGAAUAAag-3'<br>3'-UACUAAUUCCCAGAAAUGCCUUAUUUC-5'<br>Target: 5'-ATGATTAAGGGTCTTTACGGAATAAAG-3' | (SEQ ID NO: 2030)<br>(SEQ ID NO: 4044)<br>(SEQ ID NO: 6058) |

TABLE 12-continued

Additional Selected Human Anti-Lactate Dehydrogenase DsiRNA Agents (Asymmetrics)

|  |  |  |
|---|---|---|
| LDHA-1125 Target: | 5'-AUUAAGGGUCUUUACGGAAUAAAGg-3'<br>3'-ACUAAUUCCCAGAAAUGCCUUAUUUCC-5'<br>5'-TGATTAAGGGTCTTTACGGAATAAAGG-3' | (SEQ ID NO: 2031)<br>(SEQ ID NO: 4045)<br>(SEQ ID NO: 6059) |
| LDHA-1126 Target: | 5'-UUAAGGGUCUUUACGGAAUAAAGga-3'<br>3'-CUAAUUCCCAGAAAUGCCUUAUUUCCU-5'<br>5'-GATTAAGGGTCTTTACGGAATAAAGGA-3' | (SEQ ID NO: 2032)<br>(SEQ ID NO: 4046)<br>(SEQ ID NO: 6060) |
| LDHA-1127 Target: | 5'-UAAGGGUCUUUACGGAAUAAAGGat-3'<br>3'-UAAUUCCCAGAAAUGCCUUAUUUCCUA-5'<br>5'-ATTAAGGGTCTTTACGGAATAAAGGAT-3' | (SEQ ID NO: 2033)<br>(SEQ ID NO: 4047)<br>(SEQ ID NO: 6061) |
| LDHA-1128 Target: | 5'-AAGGGUCUUUACGGAAUAAAGGAtg-3'<br>3'-AAUUCCCAGAAAUGCCUUAUUUCCUAC-5'<br>5'-TTAAGGGTCTTTACGGAATAAAGGATG-3' | (SEQ ID NO: 2034)<br>(SEQ ID NO: 4048)<br>(SEQ ID NO: 6062) |
| LDHA-1129 Target: | 5'-AGGGUCUUUACGGAAUAAAGGAUga-3'<br>3'-AUUCCCAGAAAUGCCUUAUUUCCUACU-5'<br>5'-TAAGGGTCTTTACGGAATAAAGGATGA-3' | (SEQ ID NO: 2035)<br>(SEQ ID NO: 4049)<br>(SEQ ID NO: 6063) |
| LDHA-1130 Target: | 5'-GGGUCUUUACGGAAUAAAGGAUGat-3'<br>3'-UUCCCAGAAAUGCCUUAUUUCCUACUA-5'<br>5'-AAGGGTCTTTACGGAATAAAGGATGAT-3' | (SEQ ID NO: 2036)<br>(SEQ ID NO: 4050)<br>(SEQ ID NO: 6064) |
| LDHA-1131 Target: | 5'-GGUCUUUACGGAAUAAAGGAUGAtg-3'<br>3'-UCCCAGAAAUGCCUUAUUUCCUACUAC-5'<br>5'-AGGGTCTTTACGGAATAAAGGATGATG-3' | (SEQ ID NO: 2037)<br>(SEQ ID NO: 4051)<br>(SEQ ID NO: 6065) |
| LDHA-1132 Target: | 5'-GUCUUUACGGAAUAAAGGAUGAUgt-3'<br>3'-CCCAGAAAUGCCUUAUUUCCUACUACA-5'<br>5'-GGGTCTTTACGGAATAAAGGATGATGT-3' | (SEQ ID NO: 2038)<br>(SEQ ID NO: 4052)<br>(SEQ ID NO: 6066) |
| LDHA-1133 Target: | 5'-UCUUUACGGAAUAAAGGAUGAUGtc-3'<br>3'-CCAGAAAUGCCUUAUUUCCUACUACAG-5'<br>5'-GGTCTTTACGGAATAAAGGATGATGTC-3' | (SEQ ID NO: 2039)<br>(SEQ ID NO: 4053)<br>(SEQ ID NO: 6067) |
| LDHA-1134 Target: | 5'-CUUUACGGAAUAAAGGAUGAUGUct-3'<br>3'-CAGAAAUGCCUUAUUUCCUACUACAGA-5'<br>5'-GTCTTTACGGAATAAAGGATGATGTCT-3' | (SEQ ID NO: 2040)<br>(SEQ ID NO: 4054)<br>(SEQ ID NO: 6068) |
| LDHA-1135 Target: | 5'-UUUACGGAAUAAAGGAUGAUGUCtt-3'<br>3'-AGAAAUGCCUUAUUUCCUACUACAGAA-5'<br>5'-TCTTTACGGAATAAAGGATGATGTCTT-3' | (SEQ ID NO: 2041)<br>(SEQ ID NO: 4055)<br>(SEQ ID NO: 6069) |
| LDHA-1136 Target: | 5'-UUACGGAAUAAAGGAUGAUGUCUtc-3'<br>3'-GAAAUGCCUUAUUUCCUACUACAGAAG-5'<br>5'-CTTTACGGAATAAAGGATGATGTCTTC-3' | (SEQ ID NO: 2042)<br>(SEQ ID NO: 4056)<br>(SEQ ID NO: 6070) |
| LDHA-1137 Target: | 5'-UACGGAAUAAAGGAUGAUGUCUUcc-3'<br>3'-AAAUGCCUUAUUUCCUACUACAGAAGG-5'<br>5'-TTTACGGAATAAAGGATGATGTCTTCC-3' | (SEQ ID NO: 2043)<br>(SEQ ID NO: 4057)<br>(SEQ ID NO: 6071) |
| LDHA-1138 Target: | 5'-ACGGAAUAAAGGAUGAUGUCUUCct-3'<br>3'-AAUGCCUUAUUUCCUACUACAGAAGGA-5'<br>5'-TTACGGAATAAAGGATGATGTCTTCCT-3' | (SEQ ID NO: 2044)<br>(SEQ ID NO: 4058)<br>(SEQ ID NO: 6072) |
| LDHA-1139 Target: | 5'-CGGAAUAAAGGAUGAUGUCUUCCtt-3'<br>3'-AUGCCUUAUUUCCUACUACAGAAGGAA-5'<br>5'-TACGGAATAAAGGATGATGTCTTCCTT-3' | (SEQ ID NO: 2045)<br>(SEQ ID NO: 4059)<br>(SEQ ID NO: 6073) |
| LDHA-1140 Target: | 5'-GGAAUAAAGGAUGAUGUCUUCCUta-3'<br>3'-UGCCUUAUUUCCUACUACAGAAGGAAU-5'<br>5'-ACGGAATAAAGGATGATGTCTTCCTTA-3' | (SEQ ID NO: 2046)<br>(SEQ ID NO: 4060)<br>(SEQ ID NO: 6074) |
| LDHA-1141 Target: | 5'-GAAUAAAGGAUGAUGUCUUCCUUag-3'<br>3'-GCCUUAUUUCCUACUACAGAAGGAAUC-5'<br>5'-CGGAATAAAGGATGATGTCTTCCTTAG-3' | (SEQ ID NO: 2047)<br>(SEQ ID NO: 4061)<br>(SEQ ID NO: 6075) |
| LDHA-1142 Target: | 5'-AAUAAAGGAUGAUGUCUUCCUUAgt-3'<br>3'-CCUUAUUUCCUACUACAGAAGGAAUCA-5'<br>5'-GGAATAAAGGATGATGTCTTCCTTAGT-3' | (SEQ ID NO: 2048)<br>(SEQ ID NO: 4062)<br>(SEQ ID NO: 6076) |
| LDHA-1143 Target: | 5'-AUAAAGGAUGAUGUCUUCCUUAGtg-3'<br>3'-CUUAUUUCCUACUACAGAAGGAAUCAC-5'<br>5'-GAATAAAGGATGATGTCTTCCTTAGTG-3' | (SEQ ID NO: 2049)<br>(SEQ ID NO: 4063)<br>(SEQ ID NO: 6077) |

TABLE 12-continued

Additional Selected Human Anti-Lactate Dehydrogenase DsiRNA Agents (Asymmetrics)

|  | | |
|---|---|---|
| LDHA-1144 | 5'-U<u>AA</u>AGGAUGAUGU<u>C</u>UU<u>CC</u>UUAGUGt-3'<br>3'-<u>UUAUUU</u>CCUACUAC<u>AG</u>AAGGAAUC<u>ACA</u>-5'<br>Target: 5'-AATAAAGGATGATGTCTTCCTTAGTGT-3' | (SEQ ID NO: 2050)<br>(SEQ ID NO: 4064)<br>(SEQ ID NO: 6078) |
| LDHA-1145 | 5'-A<u>AA</u>GGAUGAUGUC<u>UU</u>C<u>C</u>UUAGUGtt-3'<br>3'-<u>UAUUU</u>CCUACUACAG<u>A</u>AGGAAUC<u>ACAA</u>-5'<br>Target: 5'-ATAAAGGATGATGTCTTCCTTAGTGTT-3' | (SEQ ID NO: 2051)<br>(SEQ ID NO: 4065)<br>(SEQ ID NO: 6079) |
| LDHA-1146 | 5'-<u>AA</u>GGAUGAUGUCUU<u>CC</u>UUAGUGUtc-3'<br>3'-<u>AUUU</u>CCUACUACAG<u>A</u>AGGAAUCA<u>CAAG</u>-5'<br>Target: 5'-TAAAGGATGATGTCTTCCTTAGTGTTC-3' | (SEQ ID NO: 2052)<br>(SEQ ID NO: 4066)<br>(SEQ ID NO: 6080) |
| LDHA-1147 | 5'-<u>A</u>GGAUGAUGUCUU<u>CC</u>UUAGUGUUcc-3'<br>3'-<u>UUU</u>CCUACUACAGA<u>A</u>GGAAUCAC<u>AAGG</u>-5'<br>Target: 5'-AAAGGATGATGTCTTCCTTAGTGTTCC-3' | (SEQ ID NO: 2053)<br>(SEQ ID NO: 4067)<br>(SEQ ID NO: 6081) |
| LDHA-1148 | 5'-GGAUGAUGUCUUCC<u>U</u>UAGUGUUCct-3'<br>3'-<u>UU</u>CCUACUACAGAA<u>GG</u>AAUCACAA<u>GGA</u>-5'<br>Target: 5'-AAGGATGATGTCTTCCTTAGTGTTCCT-3' | (SEQ ID NO: 2054)<br>(SEQ ID NO: 4068)<br>(SEQ ID NO: 6082) |
| LDHA-1149 | 5'-GAUGAUGUCUUCC<u>UU</u>AGUGUUCCtt-3'<br>3'-<u>U</u>CCUACUACAGAAG<u>GA</u>AUCACAAG<u>GAA</u>-5'<br>Target: 5'-AGGATGATGTCTTCCTTAGTGTTCCTT-3' | (SEQ ID NO: 2055)<br>(SEQ ID NO: 4069)<br>(SEQ ID NO: 6083) |
| LDHA-1150 | 5'-AUGAUGUCUUCC<u>UUA</u>GUGUUCCUtg-3'<br>3'-<u>CC</u>UACUACAGAAGG<u>AA</u>UCACAAGG<u>AAC</u>-5'<br>Target: 5'-GGATGATGTCTTCCTTAGTGTTCCTTG-3' | (SEQ ID NO: 2056)<br>(SEQ ID NO: 4070)<br>(SEQ ID NO: 6084) |
| LDHA-1151 | 5'-UGAUGUCUUCCUU<u>A</u>GUGUUCCUUgc-3'<br>3'-<u>C</u>UACUACAGAAGGA<u>AU</u>CACAAGGA<u>ACG</u>-5'<br>Target: 5'-GATGATGTCTTCCTTAGTGTTCCTTGC-3' | (SEQ ID NO: 2057)<br>(SEQ ID NO: 4071)<br>(SEQ ID NO: 6085) |
| LDHA-1152 | 5'-GA<u>U</u>GUCUUCCUUA<u>G</u>U<u>G</u>UUCCUUGca-3'<br>3'-<u>U</u>ACUACAGAAGGAA<u>UC</u>ACAAGGAA<u>CGU</u>-5'<br>Target: 5'-ATGATGTCTTCCTTAGTGTTCCTTGCA-3' | (SEQ ID NO: 2058)<br>(SEQ ID NO: 4072)<br>(SEQ ID NO: 6086) |
| LDHA-1153 | 5'-A<u>U</u>GUCUUCCUUAG<u>U</u>GUUCCUUGCat-3'<br>3'-<u>A</u>CUACAGAAGGAAUC<u>A</u>CAAGGAAC<u>GUA</u>-5'<br>Target: 5'-TGATGTCTTCCTTAGTGTTCCTTGCAT-3' | (SEQ ID NO: 2059)<br>(SEQ ID NO: 4073)<br>(SEQ ID NO: 6087) |
| LDHA-1154 | 5'-U<u>GU</u>CUUCCUUAGU<u>G</u>U<u>U</u>CCUUGCAtt-3'<br>3'-<u>CUAC</u>AGAAGGAAUC<u>AC</u>AAGGAACG<u>UAA</u>-5'<br>Target: 5'-GATGTCTTCCTTAGTGTTCCTTGCATT-3' | (SEQ ID NO: 2060)<br>(SEQ ID NO: 4074)<br>(SEQ ID NO: 6088) |
| LDHA-1155 | 5'-G<u>U</u>C<u>UU</u>CCUUAGUGU<u>U</u>CC<u>U</u>UGCAUtt-3'<br>3'-<u>UAC</u>AGAAGGAAUCA<u>C</u>AAGGAACGU<u>AAA</u>-5'<br>Target: 5'-ATGTCTTCCTTAGTGTTCCTTGCATTT-3' | (SEQ ID NO: 2061)<br>(SEQ ID NO: 4075)<br>(SEQ ID NO: 6089) |
| LDHA-1156 | 5'-U<u>CUU</u>CCUUAGUGUU<u>CC</u>UUGCAUUtt-3'<br>3'-<u>AC</u>AGAAGGAAUCAC<u>AA</u>GGAACGU<u>AAAA</u>-5'<br>Target: 5'-TGTCTTCCTTAGTGTTCCTTGCATTTT-3' | (SEQ ID NO: 2062)<br>(SEQ ID NO: 4076)<br>(SEQ ID NO: 6090) |
| LDHA-1157 | 5'-C<u>UU</u>CCUUAGUGUUCC<u>U</u>UGCAUUUtg-3'<br>3'-<u>CA</u>GAAGGAAUCACAA<u>GG</u>AACGUAA<u>AAC</u>-5'<br>Target: 5'-GTCTTCCTTAGTGTTCCTTGCATTTTG-3' | (SEQ ID NO: 2063)<br>(SEQ ID NO: 4077)<br>(SEQ ID NO: 6091) |
| LDHA-1158 | 5'-U<u>U</u>CCUUAGUGUUCC<u>U</u>UGCAUUUUgg-3'<br>3'-<u>A</u>GAAGGAAUCACAAGG<u>A</u>ACGUAAA<u>ACC</u>-5'<br>Target: 5'-TCTTCCTTAGTGTTCCTTGCATTTTGG-3' | (SEQ ID NO: 2064)<br>(SEQ ID NO: 4078)<br>(SEQ ID NO: 6092) |
| LDHA-1159 | 5'-U<u>C</u>CUUAGUGUUCC<u>UU</u>GCAUUUUGgg-3'<br>3'-<u>GA</u>AGGAAUCACAAGG<u>AA</u>CGUAAAA<u>CCC</u>-5'<br>Target: 5'-CTTCCTTAGTGTTCCTTGCATTTTGGG-3' | (SEQ ID NO: 2065)<br>(SEQ ID NO: 4079)<br>(SEQ ID NO: 6093) |
| LDHA-1160 | 5'-<u>CC</u>UUAGUGUUCC<u>UUG</u>C<u>A</u>UUUUGGga-3'<br>3'-<u>AAGG</u>AAUCACAAGGA<u>A</u>CGUAAAA<u>CCCU</u>-5'<br>Target: 5'-TTCCTTAGTGTTCCTTGCATTTTGGGA-3' | (SEQ ID NO: 2066)<br>(SEQ ID NO: 4080)<br>(SEQ ID NO: 6094) |
| LDHA-1161 | 5'-C<u>UU</u>AGUGUUCCUUG<u>C</u>AUUUUGGGac-3'<br>3'-<u>A</u>GGAAUCACAAGGAAC<u>G</u>UAAAACC<u>CUG</u>-5'<br>Target: 5'-TCCTTAGTGTTCCTTGCATTTTGGGAC-3' | (SEQ ID NO: 2067)<br>(SEQ ID NO: 4081)<br>(SEQ ID NO: 6095) |
| LDHA-1162 | 5'-UU<u>A</u>GUGUUCCUUGC<u>A</u>UUUUGGGAca-3'<br>3'-<u>GG</u>AAUCACAAGGAAC<u>G</u>UAAAACCC<u>UGU</u>-5'<br>Target: 5'-CCTTAGTGTTCCTTGCATTTTGGGACA-3' | (SEQ ID NO: 2068)<br>(SEQ ID NO: 4082)<br>(SEQ ID NO: 6096) |

TABLE 12-continued

Additional Selected Human Anti-Lactate Dehydrogenase DsiRNA Agents (Asymmetrics)

| | | |
|---|---|---|
| | 5'-UAGUGUUCCUUGCAUUUUGGGACag-3' | (SEQ ID NO: 2069) |
| | 3'-GAAUCACAAGGAACGUAAAACCCUGUC-5' | (SEQ ID NO: 4083) |
| LDHA-1163 Target: | 5'-CTTAGTGTTCCTTGCATTTTGGGACAG-3' | (SEQ ID NO: 6097) |
| | 5'-AGUGUUCCUUGCAUUUUGGGACAga-3' | (SEQ ID NO: 2070) |
| | 3'-AAUCACAAGGAACGUAAAACCCUGUCU-5' | (SEQ ID NO: 4084) |
| LDHA-1164 Target: | 5'-TTAGTGTTCCTTGCATTTTGGGACAGA-3' | (SEQ ID NO: 6098) |
| | 5'-GUGUUCCUUGCAUUUUGGGACAGaa-3' | (SEQ ID NO: 2071) |
| | 3'-AUCACAAGGAACGUAAAACCCUGUCUU-5' | (SEQ ID NO: 4085) |
| LDHA-1165 Target: | 5'-TAGTGTTCCTTGCATTTTGGGACAGAA-3' | (SEQ ID NO: 6099) |
| | 5'-UGUUCCUUGCAUUUUGGGACAGAat-3' | (SEQ ID NO: 2072) |
| | 3'-UCACAAGGAACGUAAAACCCUGUCUUA-5' | (SEQ ID NO: 4086) |
| LDHA-1166 Target: | 5'-AGTGTTCCTTGCATTTTGGGACAGAAT-3' | (SEQ ID NO: 6100) |
| | 5'-GUUCCUUGCAUUUUGGGACAGAAtg-3' | (SEQ ID NO: 2073) |
| | 3'-CACAAGGAACGUAAAACCCUGUCUUAC-5' | (SEQ ID NO: 4087) |
| LDHA-1167 Target: | 5'-GTGTTCCTTGCATTTTGGGACAGAATG-3' | (SEQ ID NO: 6101) |
| | 5'-UUCCUUGCAUUUUGGGACAGAAUgg-3' | (SEQ ID NO: 2074) |
| | 3'-ACAAGGAACGUAAAACCCUGUCUUACC-5' | (SEQ ID NO: 4088) |
| LDHA-1168 Target: | 5'-TGTTCCTTGCATTTTGGGACAGAATGG-3' | (SEQ ID NO: 6102) |
| | 5'-UCCUUGCAUUUUGGGACAGAAUGga-3' | (SEQ ID NO: 2075) |
| | 3'-CAAGGAACGUAAAACCCUGUCUUACCU-5' | (SEQ ID NO: 4089) |
| LDHA-1169 Target: | 5'-GTTCCTTGCATTTTGGGACAGAATGGA-3' | (SEQ ID NO: 6103) |
| | 5'-CCUUGCAUUUUGGGACAGAAUGGaa-3' | (SEQ ID NO: 2076) |
| | 3'-AAGGAACGUAAAACCCUGUCUUACCUU-5' | (SEQ ID NO: 4090) |
| LDHA-1170 Target: | 5'-TTCCTTGCATTTTGGGACAGAATGGAA-3' | (SEQ ID NO: 6104) |
| | 5'-CUUGCAUUUUGGGACAGAAUGGAat-3' | (SEQ ID NO: 2077) |
| | 3'-AGGAACGUAAAACCCUGUCUUACCUUA-5' | (SEQ ID NO: 4091) |
| LDHA-1171 Target: | 5'-TCCTTGCATTTTGGGACAGAATGGAAT-3' | (SEQ ID NO: 6105) |
| | 5'-UUGCAUUUUGGGACAGAAUGGAAtc-3' | (SEQ ID NO: 2078) |
| | 3'-GGAACGUAAAACCCUGUCUUACCUUAG-5' | (SEQ ID NO: 4092) |
| LDHA-1172 Target: | 5'-CCTTGCATTTTGGGACAGAATGGAATC-3' | (SEQ ID NO: 6106) |
| | 5'-UGCAUUUUGGGACAGAAUGGAAUct-3' | (SEQ ID NO: 2079) |
| | 3'-GAACGUAAAACCCUGUCUUACCUUAGA-5' | (SEQ ID NO: 4093) |
| LDHA-1173 Target: | 5'-CTTGCATTTTGGGACAGAATGGAATCT-3' | (SEQ ID NO: 6107) |
| | 5'-GCAUUUUGGGACAGAAUGGAAUCtc-3' | (SEQ ID NO: 2080) |
| | 3'-AACGUAAAACCCUGUCUUACCUUAGAG-5' | (SEQ ID NO: 4094) |
| LDHA-1174 Target: | 5'-TTGCATTTTGGGACAGAATGGAATCTC-3' | (SEQ ID NO: 6108) |
| | 5'-CAUUUUGGGACAGAAUGGAAUCUca-3' | (SEQ ID NO: 2081) |
| | 3'-ACGUAAAACCCUGUCUUACCUUAGAGU-5' | (SEQ ID NO: 4095) |
| LDHA-1175 Target: | 5'-TGCATTTTGGGACAGAATGGAATCTCA-3' | (SEQ ID NO: 6109) |
| | 5'-AUUUUGGGACAGAAUGGAAUCUCag-3' | (SEQ ID NO: 2082) |
| | 3'-CGUAAAACCCUGUCUUACCUUAGAGUC-5' | (SEQ ID NO: 4096) |
| LDHA-1176 Target: | 5'-GCATTTTGGGACAGAATGGAATCTCAG-3' | (SEQ ID NO: 6110) |
| | 5'-UUUUGGGACAGAAUGGAAUCUCAga-3' | (SEQ ID NO: 2083) |
| | 3'-GUAAAACCCUGUCUUACCUUAGAGUCU-5' | (SEQ ID NO: 4097) |
| LDHA-1177 Target: | 5'-CATTTTGGGACAGAATGGAATCTCAGA-3' | (SEQ ID NO: 6111) |
| | 5'-UUUGGGACAGAAUGGAAUCUCAGac-3' | (SEQ ID NO: 2084) |
| | 3'-UAAAACCCUGUCUUACCUUAGAGUCUG-5' | (SEQ ID NO: 4098) |
| LDHA-1178 Target: | 5'-ATTTTGGGACAGAATGGAATCTCAGAC-3' | (SEQ ID NO: 6112) |
| | 5'-UUGGGACAGAAUGGAAUCUCAGAcc-3' | (SEQ ID NO: 2085) |
| | 3'-AAAACCCUGUCUUACCUUAGAGUCUGG-5' | (SEQ ID NO: 4099) |
| LDHA-1179 Target: | 5'-TTTTGGGACAGAATGGAATCTCAGACC-3' | (SEQ ID NO: 6113) |
| | 5'-UGGGACAGAAUGGAAUCUCAGACct-3' | (SEQ ID NO: 2086) |
| | 3'-AAACCCUGUCUUACCUUAGAGUCUGGA-5' | (SEQ ID NO: 4100) |
| LDHA-1180 Target: | 5'-TTTGGGACAGAATGGAATCTCAGACCT-3' | (SEQ ID NO: 6114) |
| | 5'-GGGACAGAAUGGAAUCUCAGACCtt-3' | (SEQ ID NO: 2087) |
| | 3'-AACCCUGUCUUACCUUAGAGUCUGGAA-5' | (SEQ ID NO: 4101) |
| LDHA-1181 Target: | 5'-TTGGGACAGAATGGAATCTCAGACCTT-3' | (SEQ ID NO: 6115) |

TABLE 12-continued

Additional Selected Human Anti-Lactate Dehydrogenase DsiRNA Agents (Asymmetrics)

|  |  |  |
|---|---|---|
| LDHA-1182 | 5'-GGACAGAAUGGAAUCUCAGACCUtg-3'<br>3'-ACCCUGUCUUACCUUAGAGUCUGGAAC-5'<br>Target: 5'-TGGGACAGAATGGAATCTCAGACCTTG-3' | (SEQ ID NO: 2088)<br>(SEQ ID NO: 4102)<br>(SEQ ID NO: 6116) |
| LDHA-1183 | 5'-GACAGAAUGGAAUCUCAGACCUUgt-3'<br>3'-CCCUGUCUUACCUUAGAGUCUGGAACA-5'<br>Target: 5'-GGGACAGAATGGAATCTCAGACCTTGT-3' | (SEQ ID NO: 2089)<br>(SEQ ID NO: 4103)<br>(SEQ ID NO: 6117) |
| LDHA-1184 | 5'-ACAGAAUGGAAUCUCAGACCUUGtg-3'<br>3'-CCUGUCUUACCUUAGAGUCUGGAACAC-5'<br>Target: 5'-GGACAGAATGGAATCTCAGACCTTGTG-3' | (SEQ ID NO: 2090)<br>(SEQ ID NO: 4104)<br>(SEQ ID NO: 6118) |
| LDHA-1185 | 5'-CAGAAUGGAAUCUCAGACCUUGUga-3'<br>3'-CUGUCUUACCUUAGAGUCUGGAACACU-5'<br>Target: 5'-GACAGAATGGAATCTCAGACCTTGTGA-3' | (SEQ ID NO: 2091)<br>(SEQ ID NO: 4105)<br>(SEQ ID NO: 6119) |
| LDHA-1186 | 5'-AGAAUGGAAUCUCAGACCUUGUGaa-3'<br>3'-UGUCUUACCUUAGAGUCUGGAACACUU-5'<br>Target: 5'-ACAGAATGGAATCTCAGACCTTGTGAA-3' | (SEQ ID NO: 2092)<br>(SEQ ID NO: 4106)<br>(SEQ ID NO: 6120) |
| LDHA-1187 | 5'-GAAUGGAAUCUCAGACCUUGUGAag-3'<br>3'-GUCUUACCUUAGAGUCUGGAACACUUC-5'<br>Target: 5'-CAGAATGGAATCTCAGACCTTGTGAAG-3' | (SEQ ID NO: 2093)<br>(SEQ ID NO: 4107)<br>(SEQ ID NO: 6121) |
| LDHA-1188 | 5'-AAUGGAAUCUCAGACCUUGUGAAgg-3'<br>3'-UCUUACCUUAGAGUCUGGAACACUUCC-5'<br>Target: 5'-AGAATGGAATCTCAGACCTTGTGAAGG-3' | (SEQ ID NO: 2094)<br>(SEQ ID NO: 4108)<br>(SEQ ID NO: 6122) |
| LDHA-1189 | 5'-AUGGAAUCUCAGACCUUGUGAAGgt-3'<br>3'-CUUACCUUAGAGUCUGGAACACUUCCA-5'<br>Target: 5'-GAATGGAATCTCAGACCTTGTGAAGGT-3' | (SEQ ID NO: 2095)<br>(SEQ ID NO: 4109)<br>(SEQ ID NO: 6123) |
| LDHA-1190 | 5'-UGGAAUCUCAGACCUUGUGAAGGtg-3'<br>3'-UUACCUUAGAGUCUGGAACACUUCCAC-5'<br>Target: 5'-AATGGAATCTCAGACCTTGTGAAGGTG-3' | (SEQ ID NO: 2096)<br>(SEQ ID NO: 4110)<br>(SEQ ID NO: 6124) |
| LDHA-1191 | 5'-GGAAUCUCAGACCUUGUGAAGGUga-3'<br>3'-UACCUUAGAGUCUGGAACACUUCCACU-5'<br>Target: 5'-ATGGAATCTCAGACCTTGTGAAGGTGA-3' | (SEQ ID NO: 2097)<br>(SEQ ID NO: 4111)<br>(SEQ ID NO: 6125) |
| LDHA-1192 | 5'-GAAUCUCAGACCUUGUGAAGGUGac-3'<br>3'-ACCUUAGAGUCUGGAACACUUCCACUG-5'<br>Target: 5'-TGGAATCTCAGACCTTGTGAAGGTGAC-3' | (SEQ ID NO: 2098)<br>(SEQ ID NO: 4112)<br>(SEQ ID NO: 6126) |
| LDHA-1193 | 5'-AAUCUCAGACCUUGUGAAGGUGAct-3'<br>3'-CCUUAGAGUCUGGAACACUUCCACUGA-5'<br>Target: 5'-GGAATCTCAGACCTTGTGAAGGTGACT-3' | (SEQ ID NO: 2099)<br>(SEQ ID NO: 4113)<br>(SEQ ID NO: 6127) |
| LDHA-1194 | 5'-AUCUCAGACCUUGUGAAGGUGACtc-3'<br>3'-CUUAGAGUCUGGAACACUUCCACUGAG-5'<br>Target: 5'-GAATCTCAGACCTTGTGAAGGTGACTC-3' | (SEQ ID NO: 2100)<br>(SEQ ID NO: 4114)<br>(SEQ ID NO: 6128) |
| LDHA-1195 | 5'-UCUCAGACCUUGUGAAGGUGACUct-3'<br>3'-UUAGAGUCUGGAACACUUCCACUGAGA-5'<br>Target: 5'-AATCTCAGACCTTGTGAAGGTGACTCT-3' | (SEQ ID NO: 2101)<br>(SEQ ID NO: 4115)<br>(SEQ ID NO: 6129) |
| LDHA-1196 | 5'-CUCAGACCUUGUGAAGGUGACUCtg-3'<br>3'-UAGAGUCUGGAACACUUCCACUGAGAC-5'<br>Target: 5'-ATCTCAGACCTTGTGAAGGTGACTCTG-3' | (SEQ ID NO: 2102)<br>(SEQ ID NO: 4116)<br>(SEQ ID NO: 6130) |
| LDHA-1197 | 5'-UCAGACCUUGUGAAGGUGACUCUga-3'<br>3'-AGAGUCUGGAACACUUCCACUGAGACU-5'<br>Target: 5'-TCTCAGACCTTGTGAAGGTGACTCTGA-3' | (SEQ ID NO: 2103)<br>(SEQ ID NO: 4117)<br>(SEQ ID NO: 6131) |
| LDHA-1198 | 5'-CAGACCUUGUGAAGGUGACUCUGac-3'<br>3'-GAGUCUGGAACACUUCCACUGAGACUG-5'<br>Target: 5'-CTCAGACCTTGTGAAGGTGACTCTGAC-3' | (SEQ ID NO: 2104)<br>(SEQ ID NO: 4118)<br>(SEQ ID NO: 6132) |
| LDHA-1199 | 5'-AGACCUUGUGAAGGUGACUCUGAct-3'<br>3'-AGUCUGGAACACUUCCACUGAGACUGA-5'<br>Target: 5'-TCAGACCTTGTGAAGGTGACTCTGACT-3' | (SEQ ID NO: 2105)<br>(SEQ ID NO: 4119)<br>(SEQ ID NO: 6133) |
| LDHA-1200 | 5'-GACCUUGUGAAGGUGACUCUGACtt-3'<br>3'-GUCUGGAACACUUCCACUGAGACUGAA-5'<br>Target: 5'-CAGACCTTGTGAAGGTGACTCTGACTT-3' | (SEQ ID NO: 2106)<br>(SEQ ID NO: 4120)<br>(SEQ ID NO: 6134) |

TABLE 12-continued

Additional Selected Human Anti-Lactate Dehydrogenase DsiRNA Agents (Asymmetrics)

|  |  |  |
|---|---|---|
| LDHA-1201 | 5'-ACCUUGUGAAGGUGACUCUGACUtc-3'<br>3'-UCUGGAACACUUCCACUGAGACUGAAG-5'<br>Target: 5'-AGACCTTGTGAAGGTGACTCTGACTTC-3' | (SEQ ID NO: 2107)<br>(SEQ ID NO: 4121)<br>(SEQ ID NO: 6135) |
| LDHA-1202 | 5'-CCUUGUGAAGGUGACUCUGACUUct-3'<br>3'-CUGGAACACUUCCACUGAGACUGAAGA-5'<br>Target: 5'-GACCTTGTGAAGGTGACTCTGACTTCT-3' | (SEQ ID NO: 2108)<br>(SEQ ID NO: 4122)<br>(SEQ ID NO: 6136) |
| LDHA-1203 | 5'-CUUGUGAAGGUGACUCUGACUUCtg-3'<br>3'-UGGAACACUUCCACUGAGACUGAAGAC-5'<br>Target: 5'-ACCTTGTGAAGGTGACTCTGACTTCTG-3' | (SEQ ID NO: 2109)<br>(SEQ ID NO: 4123)<br>(SEQ ID NO: 6137) |
| LDHA-1204 | 5'-UUGUGAAGGUGACUCUGACUUCUga-3'<br>3'-GGAACACUUCCACUGAGACUGAAGACU-5'<br>Target: 5'-CCTTGTGAAGGTGACTCTGACTTCTGA-3' | (SEQ ID NO: 2110)<br>(SEQ ID NO: 4124)<br>(SEQ ID NO: 6138) |
| LDHA-1205 | 5'-UGUGAAGGUGACUCUGACUUCUGag-3'<br>3'-GAACACUUCCACUGAGACUGAAGACUC-5'<br>Target: 5'-CTTGTGAAGGTGACTCTGACTTCTGAG-3' | (SEQ ID NO: 2111)<br>(SEQ ID NO: 4125)<br>(SEQ ID NO: 6139) |
| LDHA-1206 | 5'-GUGAAGGUGACUCUGACUUCUGAgg-3'<br>3'-AACACUUCCACUGAGACUGAAGACUCC-5'<br>Target: 5'-TTGTGAAGGTGACTCTGACTTCTGAGG-3' | (SEQ ID NO: 2112)<br>(SEQ ID NO: 4126)<br>(SEQ ID NO: 6140) |
| LDHA-1207 | 5'-UGAAGGUGACUCUGACUUCUGAGga-3'<br>3'-ACACUUCCACUGAGACUGAAGACUCCU-5'<br>Target: 5'-TGTGAAGGTGACTCTGACTTCTGAGGA-3' | (SEQ ID NO: 2113)<br>(SEQ ID NO: 4127)<br>(SEQ ID NO: 6141) |
| LDHA-1208 | 5'-GAAGGUGACUCUGACUUCUGAGGaa-3'<br>3'-CACUUCCACUGAGACUGAAGACUCCUU-5'<br>Target: 5'-GTGAAGGTGACTCTGACTTCTGAGGAA-3' | (SEQ ID NO: 2114)<br>(SEQ ID NO: 4128)<br>(SEQ ID NO: 6142) |
| LDHA-1209 | 5'-AAGGUGACUCUGACUUCUGAGGAag-3'<br>3'-ACUUCCACUGAGACUGAAGACUCCUUC-5'<br>Target: 5'-TGAAGGTGACTCTGACTTCTGAGGAAG-3' | (SEQ ID NO: 2115)<br>(SEQ ID NO: 4129)<br>(SEQ ID NO: 6143) |
| LDHA-1210 | 5'-AGGUGACUCUGACUUCUGAGGAAga-3'<br>3'-CUUCCACUGAGACUGAAGACUCCUUCU-5'<br>Target: 5'-GAAGGTGACTCTGACTTCTGAGGAAGA-3' | (SEQ ID NO: 2116)<br>(SEQ ID NO: 4130)<br>(SEQ ID NO: 6144) |
| LDHA-1211 | 5'-GGUGACUCUGACUUCUGAGGAAGag-3'<br>3'-UUCCACUGAGACUGAAGACUCCUUCUC-5'<br>Target: 5'-AAGGTGACTCTGACTTCTGAGGAAGAG-3' | (SEQ ID NO: 2117)<br>(SEQ ID NO: 4131)<br>(SEQ ID NO: 6145) |
| LDHA-1212 | 5'-GUGACUCUGACUUCUGAGGAAGAgg-3'<br>3'-UCCACUGAGACUGAAGACUCCUUCUCC-5'<br>Target: 5'-AGGTGACTCTGACTTCTGAGGAAGAGG-3' | (SEQ ID NO: 2118)<br>(SEQ ID NO: 4132)<br>(SEQ ID NO: 6146) |
| LDHA-1213 | 5'-UGACUCUGACUUCUGAGGAAGAGgc-3'<br>3'-CCACUGAGACUGAAGACUCCUUCUCCG-5'<br>Target: 5'-GGTGACTCTGACTTCTGAGGAAGAGGC-3' | (SEQ ID NO: 2119)<br>(SEQ ID NO: 4133)<br>(SEQ ID NO: 6147) |
| LDHA-1214 | 5'-GACUCUGACUUCUGAGGAAGAGGcc-3'<br>3'-CACUGAGACUGAAGACUCCUUCUCCGG-5'<br>Target: 5'-GTGACTCTGACTTCTGAGGAAGAGGCC-3' | (SEQ ID NO: 2120)<br>(SEQ ID NO: 4134)<br>(SEQ ID NO: 6148) |
| LDHA-1215 | 5'-ACUCUGACUUCUGAGGAAGAGGCcc-3'<br>3'-ACUGAGACUGAAGACUCCUUCUCCGGG-5'<br>Target: 5'-TGACTCTGACTTCTGAGGAAGAGGCCC-3' | (SEQ ID NO: 2121)<br>(SEQ ID NO: 4135)<br>(SEQ ID NO: 6149) |
| LDHA-1216 | 5'-CUCUGACUUCUGAGGAAGAGGCCcg-3'<br>3'-CUGAGACUGAAGACUCCUUCUCCGGGC-5'<br>Target: 5'-GACTCTGACTTCTGAGGAAGAGGCCCG-3' | (SEQ ID NO: 2122)<br>(SEQ ID NO: 4136)<br>(SEQ ID NO: 6150) |
| LDHA-1217 | 5'-UCUGACUUCUGAGGAAGAGGCCCgt-3'<br>3'-UGAGACUGAAGACUCCUUCUCCGGGCA-5'<br>Target: 5'-ACTCTGACTTCTGAGGAAGAGGCCCGT-3' | (SEQ ID NO: 2123)<br>(SEQ ID NO: 4137)<br>(SEQ ID NO: 6151) |
| LDHA-1218 | 5'-CUGACUUCUGAGGAAGAGGCCCGtt-3'<br>3'-GAGACUGAAGACUCCUUCUCCGGGCAA-5'<br>Target: 5'-CTCTGACTTCTGAGGAAGAGGCCCGTT-3' | (SEQ ID NO: 2124)<br>(SEQ ID NO: 4138)<br>(SEQ ID NO: 6152) |
| LDHA-1219 | 5'-UGACUUCUGAGGAAGAGGCCCGUtt-3'<br>3'-AGACUGAAGACUCCUUCUCCGGGCAAA-5'<br>Target: 5'-TCTGACTTCTGAGGAAGAGGCCCGTTT-3' | (SEQ ID NO: 2125)<br>(SEQ ID NO: 4139)<br>(SEQ ID NO: 6153) |

TABLE 12-continued

Additional Selected Human Anti-Lactate Dehydrogenase DsiRNA Agents (Asymmetrics)

| | | |
|---|---|---|
| LDHA-1220 | 5'-GACUUCUGAGGAAGAGGCCCGUUtg-3'<br>3'-GACUGAAGACUCCUUCUCCGGGCAAAC-5'<br>Target: 5'-CTGACTTCTGAGGAAGAGGCCCGTTTG-3' | (SEQ ID NO: 2126)<br>(SEQ ID NO: 4140)<br>(SEQ ID NO: 6154) |
| LDHA-1221 | 5'-ACUUCUGAGGAAGAGGCCCGUUUga-3'<br>3'-ACUGAAGACUCCUUCUCCGGGCAAACU-5'<br>Target: 5'-TGACTTCTGAGGAAGAGGCCCGTTTGA-3' | (SEQ ID NO: 2127)<br>(SEQ ID NO: 4141)<br>(SEQ ID NO: 6155) |
| LDHA-1222 | 5'-CUUCUGAGGAAGAGGCCCGUUUGaa-3'<br>3'-CUGAAGACUCCUUCUCCGGGCAAACUU-5'<br>Target: 5'-GACTTCTGAGGAAGAGGCCCGTTTGAA-3' | (SEQ ID NO: 2128)<br>(SEQ ID NO: 4142)<br>(SEQ ID NO: 6156) |
| LDHA-1223 | 5'-UUCUGAGGAAGAGGCCCGUUUGAag-3'<br>3'-UGAAGACUCCUUCUCCGGGCAAACUUC-5'<br>Target: 5'-ACTTCTGAGGAAGAGGCCCGTTTGAAG-3' | (SEQ ID NO: 2129)<br>(SEQ ID NO: 4143)<br>(SEQ ID NO: 6157) |
| LDHA-1224 | 5'-UCUGAGGAAGAGGCCCGUUUGAAga-3'<br>3'-GAAGACUCCUUCUCCGGGCAAACUUCU-5'<br>Target: 5'-CTTCTGAGGAAGAGGCCCGTTTGAAGA-3' | (SEQ ID NO: 2130)<br>(SEQ ID NO: 4144)<br>(SEQ ID NO: 6158) |
| LDHA-1225 | 5'-CUGAGGAAGAGGCCCGUUUGAAGaa-3'<br>3'-AAGACUCCUUCUCCGGGCAAACUUCUU-5'<br>Target: 5'-TTCTGAGGAAGAGGCCCGTTTGAAGAA-3' | (SEQ ID NO: 2131)<br>(SEQ ID NO: 4145)<br>(SEQ ID NO: 6159) |
| LDHA-1226 | 5'-UGAGGAAGAGGCCCGUUUGAAGAag-3'<br>3'-AGACUCCUUCUCCGGGCAAACUUCUUC-5'<br>Target: 5'-TCTGAGGAAGAGGCCCGTTTGAAGAAG-3' | (SEQ ID NO: 2132)<br>(SEQ ID NO: 4146)<br>(SEQ ID NO: 6160) |
| LDHA-1227 | 5'-GAGGAAGAGGCCCGUUUGAAGAAga-3'<br>3'-GACUCCUUCUCCGGGCAAACUUCUUCU-5'<br>Target: 5'-CTGAGGAAGAGGCCCGTTTGAAGAAGA-3' | (SEQ ID NO: 2133)<br>(SEQ ID NO: 4147)<br>(SEQ ID NO: 6161) |
| LDHA-1228 | 5'-AGGAAGAGGCCCGUUUGAAGAAGag-3'<br>3'-ACUCCUUCUCCGGGCAAACUUCUUCUC-5'<br>Target: 5'-TGAGGAAGAGGCCCGTTTGAAGAAGAG-3' | (SEQ ID NO: 2134)<br>(SEQ ID NO: 4148)<br>(SEQ ID NO: 6162) |
| LDHA-1229 | 5'-GGAAGAGGCCCGUUUGAAGAAGAgt-3'<br>3'-CUCCUUCUCCGGGCAAACUUCUUCUCA-5'<br>Target: 5'-GAGGAAGAGGCCCGTTTGAAGAAGAGT-3' | (SEQ ID NO: 2135)<br>(SEQ ID NO: 4149)<br>(SEQ ID NO: 6163) |
| LDHA-1230 | 5'-GAAGAGGCCCGUUUGAAGAAGAGtg-3'<br>3'-UCCUUCUCCGGGCAAACUUCUUCUCAC-5'<br>Target: 5'-AGGAAGAGGCCCGTTTGAAGAAGAGTG-3' | (SEQ ID NO: 2136)<br>(SEQ ID NO: 4150)<br>(SEQ ID NO: 6164) |
| LDHA-1231 | 5'-AAGAGGCCCGUUUGAAGAAGAGUgc-3'<br>3'-CCUUCUCCGGGCAAACUUCUUCUCACG-5'<br>Target: 5'-GGAAGAGGCCCGTTTGAAGAAGAGTGC-3' | (SEQ ID NO: 2137)<br>(SEQ ID NO: 4151)<br>(SEQ ID NO: 6165) |
| LDHA-1232 | 5'-AGAGGCCCGUUUGAAGAAGAGUGca-3'<br>3'-CUUCUCCGGGCAAACUUCUUCUCACGU-5'<br>Target: 5'-GAAGAGGCCCGTTTGAAGAAGAGTGCA-3' | (SEQ ID NO: 2138)<br>(SEQ ID NO: 4152)<br>(SEQ ID NO: 6166) |
| LDHA-1233 | 5'-GAGGCCCGUUUGAAGAAGAGUGCag-3'<br>3'-UUCUCCGGGCAAACUUCUUCUCACGUC-5'<br>Target: 5'-AAGAGGCCCGTTTGAAGAAGAGTGCAG-3' | (SEQ ID NO: 2139)<br>(SEQ ID NO: 4153)<br>(SEQ ID NO: 6167) |
| LDHA-1234 | 5'-AGGCCCGUUUGAAGAAGAGUGCAga-3'<br>3'-UCUCCGGGCAAACUUCUUCUCACGUCU-5'<br>Target: 5'-AGAGGCCCGTTTGAAGAAGAGTGCAGA-3' | (SEQ ID NO: 2140)<br>(SEQ ID NO: 4154)<br>(SEQ ID NO: 6168) |
| LDHA-1235 | 5'-GGCCCGUUUGAAGAAGAGUGCAGat-3'<br>3'-CUCCGGGCAAACUUCUUCUCACGUCUA-5'<br>Target: 5'-GAGGCCCGTTTGAAGAAGAGTGCAGAT-3' | (SEQ ID NO: 2141)<br>(SEQ ID NO: 4155)<br>(SEQ ID NO: 6169) |
| LDHA-1236 | 5'-GCCCGUUUGAAGAAGAGUGCAGAta-3'<br>3'-UCCGGGCAAACUUCUUCUCACGUCUAU-5'<br>Target: 5'-AGGCCCGTTTGAAGAAGAGTGCAGATA-3' | (SEQ ID NO: 2142)<br>(SEQ ID NO: 4156)<br>(SEQ ID NO: 6170) |
| LDHA-1237 | 5'-CCCGUUUGAAGAAGAGUGCAGAUac-3'<br>3'-CCGGGCAAACUUCUUCUCACGUCUAUG-5'<br>Target: 5'-GGCCCGTTTGAAGAAGAGTGCAGATAC-3' | (SEQ ID NO: 2143)<br>(SEQ ID NO: 4157)<br>(SEQ ID NO: 6171) |
| LDHA-1238 | 5'-CCGUUUGAAGAAGAGUGCAGAUAca-3'<br>3'-CGGGCAAACUUCUUCUCACGUCUAUGU-5'<br>Target: 5'-GCCCGTTTGAAGAAGAGTGCAGATACA-3' | (SEQ ID NO: 2144)<br>(SEQ ID NO: 4158)<br>(SEQ ID NO: 6172) |

TABLE 12-continued

Additional Selected Human Anti-Lactate Dehydrogenase DsiRNA Agents (Asymmetrics)

|  |  |  |
| --- | --- | --- |
| LDHA-1239 Target: | 5'-CGUUUGAAGAAGAGUGCAGAUACAc-3'<br>3'-GGGCAAACUUCUUCUCACGUCUAUGUG-5'<br>5'-CCCGTTTGAAGAAGAGTGCAGATACAC-3' | (SEQ ID NO: 2145)<br>(SEQ ID NO: 4159)<br>(SEQ ID NO: 6173) |
| LDHA-1240 Target: | 5'-GUUUGAAGAAGAGUGCAGAUACAct-3'<br>3'-GGCAAACUUCUUCUCACGUCUAUGUGA-5'<br>5'-CCGTTTGAAGAAGAGTGCAGATACACT-3' | (SEQ ID NO: 2146)<br>(SEQ ID NO: 4160)<br>(SEQ ID NO: 6174) |
| LDHA-1241 Target: | 5'-UUUGAAGAAGAGUGCAGAUACACtt-3'<br>3'-GCAAACUUCUUCUCACGUCUAUGUGAA-5'<br>5'-CGTTTGAAGAAGAGTGCAGATACACTT-3' | (SEQ ID NO: 2147)<br>(SEQ ID NO: 4161)<br>(SEQ ID NO: 6175) |
| LDHA-1242 Target: | 5'-UUGAAGAAGAGUGCAGAUACACUtt-3'<br>3'-CAAACUUCUUCUCACGUCUAUGUGAAA-5'<br>5'-GTTTGAAGAAGAGTGCAGATACACTTT-3' | (SEQ ID NO: 2148)<br>(SEQ ID NO: 4162)<br>(SEQ ID NO: 6176) |
| LDHA-1243 Target: | 5'-UGAAGAAGAGUGCAGAUACACUUtg-3'<br>3'-AAACUUCUUCUCACGUCUAUGUGAAAC-5'<br>5'-TTTGAAGAAGAGTGCAGATACACTTTG-3' | (SEQ ID NO: 2149)<br>(SEQ ID NO: 4163)<br>(SEQ ID NO: 6177) |
| LDHA-1244 Target: | 5'-GAAGAAGAGUGCAGAUACACUUUgg-3'<br>3'-AACUUCUUCUCACGUCUAUGUGAAACC-5'<br>5'-TTGAAGAAGAGTGCAGATACACTTTGG-3' | (SEQ ID NO: 2150)<br>(SEQ ID NO: 4164)<br>(SEQ ID NO: 6178) |
| LDHA-1245 Target: | 5'-AAGAAGAGUGCAGAUACACUUUGgg-3'<br>3'-ACUUCUUCUCACGUCUAUGUGAAACCC-5'<br>5'-TGAAGAAGAGTGCAGATACACTTTGGG-3' | (SEQ ID NO: 2151)<br>(SEQ ID NO: 4165)<br>(SEQ ID NO: 6179) |
| LDHA-1246 Target: | 5'-AGAAGAGUGCAGAUACACUUUGGgg-3'<br>3'-CUUCUUCUCACGUCUAUGUGAAACCCC-5'<br>5'-GAAGAAGAGTGCAGATACACTTTGGGG-3' | (SEQ ID NO: 2152)<br>(SEQ ID NO: 4166)<br>(SEQ ID NO: 6180) |
| LDHA-1247 Target: | 5'-GAAGAGUGCAGAUACACUUUGGGgg-3'<br>3'-UUCUUCUCACGUCUAUGUGAAACCCCC-5'<br>5'-AAGAAGAGTGCAGATACACTTTGGGGG-3' | (SEQ ID NO: 2153)<br>(SEQ ID NO: 4167)<br>(SEQ ID NO: 6181) |
| LDHA-1248 Target: | 5'-AAGAGUGCAGAUACACUUUGGGGga-3'<br>3'-UCUUCUCACGUCUAUGUGAAACCCCCU-5'<br>5'-AGAAGAGTGCAGATACACTTTGGGGGA-3' | (SEQ ID NO: 2154)<br>(SEQ ID NO: 4168)<br>(SEQ ID NO: 6182) |
| LDHA-1249 Target: | 5'-AGAGUGCAGAUACACUUUGGGGGat-3'<br>3'-CUUCUCACGUCUAUGUGAAACCCCCUA-5'<br>5'-GAAGAGTGCAGATACACTTTGGGGGAT-3' | (SEQ ID NO: 2155)<br>(SEQ ID NO: 4169)<br>(SEQ ID NO: 6183) |
| LDHA-1250 Target: | 5'-GAGUGCAGAUACACUUUGGGGGAtc-3'<br>3'-UUCUCACGUCUAUGUGAAACCCCCUAG-5'<br>5'-AAGAGTGCAGATACACTTTGGGGGATC-3' | (SEQ ID NO: 2156)<br>(SEQ ID NO: 4170)<br>(SEQ ID NO: 6184) |
| LDHA-1251 Target: | 5'-AGUGCAGAUACACUUUGGGGGAUcc-3'<br>3'-UCUCACGUCUAUGUGAAACCCCCUAGG-5'<br>5'-AGAGTGCAGATACACTTTGGGGGATCC-3' | (SEQ ID NO: 2157)<br>(SEQ ID NO: 4171)<br>(SEQ ID NO: 6185) |
| LDHA-1252 Target: | 5'-GUGCAGAUACACUUUGGGGGAUCca-3'<br>3'-CUCACGUCUAUGUGAAACCCCCUAGGU-5'<br>5'-GAGTGCAGATACACTTTGGGGGATCCA-3' | (SEQ ID NO: 2158)<br>(SEQ ID NO: 4172)<br>(SEQ ID NO: 6186) |
| LDHA-1253 Target: | 5'-UGCAGAUACACUUUGGGGGAUCCaa-3'<br>3'-UCACGUCUAUGUGAAACCCCCUAGGUU-5'<br>5'-AGTGCAGATACACTTTGGGGGATCCAA-3' | (SEQ ID NO: 2159)<br>(SEQ ID NO: 4173)<br>(SEQ ID NO: 6187) |
| LDHA-1254 Target: | 5'-GCAGAUACACUUUGGGGGAUCCAaa-3'<br>3'-CACGUCUAUGUGAAACCCCCUAGGUUU-5'<br>5'-GTGCAGATACACTTTGGGGGATCCAAA-3' | (SEQ ID NO: 2160)<br>(SEQ ID NO: 4174)<br>(SEQ ID NO: 6188) |
| LDHA-1255 Target: | 5'-CAGAUACACUUUGGGGGAUCCAAaa-3'<br>3'-ACGUCUAUGUGAAACCCCCUAGGUUUU-5'<br>5'-TGCAGATACACTTTGGGGGATCCAAAA-3' | (SEQ ID NO: 2161)<br>(SEQ ID NO: 4175)<br>(SEQ ID NO: 6189) |
| LDHA-1256 Target: | 5'-AGAUACACUUUGGGGGAUCCAAAag-3'<br>3'-CGUCUAUGUGAAACCCCCUAGGUUUUC-5'<br>5'-GCAGATACACTTTGGGGGATCCAAAAG-3' | (SEQ ID NO: 2162)<br>(SEQ ID NO: 4176)<br>(SEQ ID NO: 6190) |
| LDHA-1257 Target: | 5'-GAUACACUUUGGGGGAUCCAAAAgg-3'<br>3'-GUCUAUGUGAAACCCCCUAGGUUUUCC-5'<br>5'-CAGATACACTTTGGGGGATCCAAAAGG-3' | (SEQ ID NO: 2163)<br>(SEQ ID NO: 4177)<br>(SEQ ID NO: 6191) |

TABLE 12-continued

Additional Selected Human Anti-Lactate Dehydrogenase DsiRNA Agents (Asymmetrics)

|  |  |  |
| --- | --- | --- |
| LDHA-1258 | 5'-AUACACUUUGGGGGAUCCAAAAGGa-3'<br>3'-UCUAUGUGAAACCCCCUAGGUUUUCCU-5'<br>Target: 5'-AGATACACTTTGGGGGATCCAAAAGGA-3' | (SEQ ID NO: 2164)<br>(SEQ ID NO: 4178)<br>(SEQ ID NO: 6192) |
| LDHA-1259 | 5'-UACACUUUGGGGGAUCCAAAAGGag-3'<br>3'-CUAUGUGAAACCCCCUAGGUUUUCCUC-5'<br>Target: 5'-GATACACTTTGGGGGATCCAAAAGGAG-3' | (SEQ ID NO: 2165)<br>(SEQ ID NO: 4179)<br>(SEQ ID NO: 6193) |
| LDHA-1260 | 5'-ACACUUUGGGGGAUCCAAAAGGAgc-3'<br>3'-UAUGUGAAACCCCCUAGGUUUUCCUCG-5'<br>Target: 5'-ATACACTTTGGGGGATCCAAAAGGAGC-3' | (SEQ ID NO: 2166)<br>(SEQ ID NO: 4180)<br>(SEQ ID NO: 6194) |
| LDHA-1261 | 5'-CACUUUGGGGGAUCCAAAAGGAGct-3'<br>3'-AUGUGAAACCCCCUAGGUUUUCCUCGA-5'<br>Target: 5'-TACACTTTGGGGGATCCAAAAGGAGCT-3' | (SEQ ID NO: 2167)<br>(SEQ ID NO: 4181)<br>(SEQ ID NO: 6195) |
| LDHA-1262 | 5'-ACUUUGGGGGAUCCAAAAGGAGCtg-3'<br>3'-UGUGAAACCCCCUAGGUUUUCCUCGAC-5'<br>Target: 5'-ACACTTTGGGGGATCCAAAAGGAGCTG-3' | (SEQ ID NO: 2168)<br>(SEQ ID NO: 4182)<br>(SEQ ID NO: 6196) |
| LDHA-1263 | 5'-CUUUGGGGGAUCCAAAAGGAGCUgc-3'<br>3'-GUGAAACCCCCUAGGUUUUCCUCGACG-5'<br>Target: 5'-CACTTTGGGGGATCCAAAAGGAGCTGC-3' | (SEQ ID NO: 2169)<br>(SEQ ID NO: 4183)<br>(SEQ ID NO: 6197) |
| LDHA-1264 | 5'-UUUGGGGGAUCCAAAAGGAGCUGca-3'<br>3'-UGAAACCCCCUAGGUUUUCCUCGACGU-5'<br>Target: 5'-ACTTTGGGGGATCCAAAAGGAGCTGCA-3' | (SEQ ID NO: 2170)<br>(SEQ ID NO: 4184)<br>(SEQ ID NO: 6198) |
| LDHA-1265 | 5'-UUGGGGGAUCCAAAAGGAGCUGCaa-3'<br>3'-GAAACCCCCUAGGUUUUCCUCGACGUU-5'<br>Target: 5'-CTTTGGGGGATCCAAAAGGAGCTGCAA-3' | (SEQ ID NO: 2171)<br>(SEQ ID NO: 4185)<br>(SEQ ID NO: 6199) |
| LDHA-1266 | 5'-UGGGGGAUCCAAAAGGAGCUGCAat-3'<br>3'-AAACCCCCUAGGUUUUCCUCGACGUUA-5'<br>Target: 5'-TTTGGGGGATCCAAAAGGAGCTGCAAT-3' | (SEQ ID NO: 2172)<br>(SEQ ID NO: 4186)<br>(SEQ ID NO: 6200) |
| LDHA-1267 | 5'-GGGGGAUCCAAAAGGAGCUGCAAtt-3'<br>3'-AACCCCCUAGGUUUUCCUCGACGUUAA-5'<br>Target: 5'-TTGGGGGATCCAAAAGGAGCTGCAATT-3' | (SEQ ID NO: 2173)<br>(SEQ ID NO: 4187)<br>(SEQ ID NO: 6201) |
| LDHA-1268 | 5'-GGGGAUCCAAAAGGAGCUGCAAUtt-3'<br>3'-ACCCCCUAGGUUUUCCUCGACGUUAAA-5'<br>Target: 5'-TGGGGGATCCAAAAGGAGCTGCAATTT-3' | (SEQ ID NO: 2174)<br>(SEQ ID NO: 4188)<br>(SEQ ID NO: 6202) |
| LDHA-1269 | 5'-GGGAUCCAAAAGGAGCUGCAAUUtt-3'<br>3'-CCCCCUAGGUUUUCCUCGACGUUAAAA-5'<br>Target: 5'-GGGGGATCCAAAAGGAGCTGCAATTTT-3' | (SEQ ID NO: 2175)<br>(SEQ ID NO: 4189)<br>(SEQ ID NO: 6203) |
| LDHA-1270 | 5'-GGAUCCAAAAGGAGCUGCAAUUUta-3'<br>3'-CCCCUAGGUUUUCCUCGACGUUAAAAU-5'<br>Target: 5'-GGGGATCCAAAAGGAGCTGCAATTTTA-3' | (SEQ ID NO: 2176)<br>(SEQ ID NO: 4190)<br>(SEQ ID NO: 6204) |
| LDHA-1271 | 5'-GAUCCAAAAGGAGCUGCAAUUUUaa-3'<br>3'-CCCUAGGUUUUCCUCGACGUUAAAAUU-5'<br>Target: 5'-GGGATCCAAAAGGAGCTGCAATTTTAA-3' | (SEQ ID NO: 2177)<br>(SEQ ID NO: 4191)<br>(SEQ ID NO: 6205) |
| LDHA-1272 | 5'-AUCCAAAAGGAGCUGCAAUUUUAaa-3'<br>3'-CCUAGGUUUUCCUCGACGUUAAAAUUU-5'<br>Target: 5'-GGATCCAAAAGGAGCTGCAATTTTAAA-3' | (SEQ ID NO: 2178)<br>(SEQ ID NO: 4192)<br>(SEQ ID NO: 6206) |
| LDHA-1273 | 5'-UCCAAAAGGAGCUGCAAUUUUAAag-3'<br>3'-CUAGGUUUUCCUCGACGUUAAAAUUUC-5'<br>Target: 5'-GATCCAAAAGGAGCTGCAATTTTAAAG-3' | (SEQ ID NO: 2179)<br>(SEQ ID NO: 4193)<br>(SEQ ID NO: 6207) |
| LDHA-1274 | 5'-CCAAAAGGAGCUGCAAUUUUAAAgt-3'<br>3'-UAGGUUUUCCUCGACGUUAAAAUUUCA-5'<br>Target: 5'-ATCCAAAAGGAGCTGCAATTTTAAAGT-3' | (SEQ ID NO: 2180)<br>(SEQ ID NO: 4194)<br>(SEQ ID NO: 6208) |
| LDHA-1275 | 5'-CAAAAGGAGCUGCAAUUUUAAAGtc-3'<br>3'-AGGUUUUCCUCGACGUUAAAAUUUCAG-5'<br>Target: 5'-TCCAAAAGGAGCTGCAATTTTAAAGTC-3' | (SEQ ID NO: 2181)<br>(SEQ ID NO: 4195)<br>(SEQ ID NO: 6209) |
| LDHA-1276 | 5'-AAAAGGAGCUGCAAUUUUAAAGUct-3'<br>3'-GGUUUUCCUCGACGUUAAAAUUUCAGA-5'<br>Target: 5'-CCAAAAGGAGCTGCAATTTTAAAGTCT-3' | (SEQ ID NO: 2182)<br>(SEQ ID NO: 4196)<br>(SEQ ID NO: 6210) |

TABLE 12-continued

Additional Selected Human Anti-Lactate Dehydrogenase DsiRNA Agents (Asymmetrics)

|  |  |  |
|---|---|---|
| LDHA-1277 | 5'-AAAGGAGCUGCAAUUUUAAAGUCtt-3'<br>3'-GUUUUCCUCGACGUUAAAAUUUCAGAA-5'<br>Target: 5'-CAAAAGGAGCTGCAATTTTAAAGTCTT-3' | (SEQ ID NO: 2183)<br>(SEQ ID NO: 4197)<br>(SEQ ID NO: 6211) |
| LDHA-1278 | 5'-AAGGAGCUGCAAUUUUAAAGUCUtc-3'<br>3'-UUUUCCUCGACGUUAAAAUUUCAGAAG-5'<br>Target: 5'-AAAAGGAGCTGCAATTTTAAAGTCTTC-3' | (SEQ ID NO: 2184)<br>(SEQ ID NO: 4198)<br>(SEQ ID NO: 6212) |
| LDHA-1279 | 5'-AGGAGCUGCAAUUUUAAAGUCUUct-3'<br>3'-UUUCCUCGACGUUAAAAUUUCAGAAGA-5'<br>Target: 5'-AAAGGAGCTGCAATTTTAAAGTCTTCT-3' | (SEQ ID NO: 2185)<br>(SEQ ID NO: 4199)<br>(SEQ ID NO: 6213) |
| LDHA-1280 | 5'-GGAGCUGCAAUUUUAAAGUCUUCtg-3'<br>3'-UUCCUCGACGUUAAAAUUUCAGAAGAC-5'<br>Target: 5'-AAGGAGCTGCAATTTTAAAGTCTTCTG-3' | (SEQ ID NO: 2186)<br>(SEQ ID NO: 4200)<br>(SEQ ID NO: 6214) |
| LDHA-1281 | 5'-GAGCUGCAAUUUUAAAGUCUUCUga-3'<br>3'-UCCUCGACGUUAAAAUUUCAGAAGACU-5'<br>Target: 5'-AGGAGCTGCAATTTTAAAGTCTTCTGA-3' | (SEQ ID NO: 2187)<br>(SEQ ID NO: 4201)<br>(SEQ ID NO: 6215) |
| LDHA-1282 | 5'-AGCUGCAAUUUUAAAGUCUUCUGat-3'<br>3'-CCUCGACGUUAAAAUUUCAGAAGACUA-5'<br>Target: 5'-GGAGCTGCAATTTTAAAGTCTTCTGAT-3' | (SEQ ID NO: 2188)<br>(SEQ ID NO: 4202)<br>(SEQ ID NO: 6216) |
| LDHA-1283 | 5'-GCUGCAAUUUUAAAGUCUUCUGAtg-3'<br>3'-CUCGACGUUAAAAUUUCAGAAGACUAC-5'<br>Target: 5'-GAGCTGCAATTTTAAAGTCTTCTGATG-3' | (SEQ ID NO: 2189)<br>(SEQ ID NO: 4203)<br>(SEQ ID NO: 6217) |
| LDHA-1284 | 5'-CUGCAAUUUUAAAGUCUUCUGAUgt-3'<br>3'-UCGACGUUAAAAUUUCAGAAGACUACA-5'<br>Target: 5'-AGCTGCAATTTTAAAGTCTTCTGATGT-3' | (SEQ ID NO: 2190)<br>(SEQ ID NO: 4204)<br>(SEQ ID NO: 6218) |
| LDHA-1285 | 5'-UGCAAUUUUAAAGUCUUCUGAUGtc-3'<br>3'-CGACGUUAAAAUUUCAGAAGACUACAG-5'<br>Target: 5'-GCTGCAATTTTAAAGTCTTCTGATGTC-3' | (SEQ ID NO: 2191)<br>(SEQ ID NO: 4205)<br>(SEQ ID NO: 6219) |
| LDHA-1288 | 5'-AAUUUUAAAGUCUUCUGAUGUCAta-3'<br>3'-CGUUAAAAUUUCAGAAGACUACAGUAU-5'<br>Target: 5'-GCAATTTTAAAGTCTTCTGATGTCATA-3' | (SEQ ID NO: 2192)<br>(SEQ ID NO: 4206)<br>(SEQ ID NO: 6220) |
| LDHA-1289 | 5'-AUUUUAAAGUCUUCUGAUGUCAUat-3'<br>3'-GUUAAAAUUUCAGAAGACUACAGUAUA-5'<br>Target: 5'-CAATTTTAAAGTCTTCTGATGTCATAT-3' | (SEQ ID NO: 2193)<br>(SEQ ID NO: 4207)<br>(SEQ ID NO: 6221) |
| LDHA-1290 | 5'-UUUUAAAGUCUUCUGAUGUCAUAtc-3'<br>3'-UUAAAAUUUCAGAAGACUACAGUAUAG-5'<br>Target: 5'-AATTTTAAAGTCTTCTGATGTCATATC-3' | (SEQ ID NO: 2194)<br>(SEQ ID NO: 4208)<br>(SEQ ID NO: 6222) |
| LDHA-1291 | 5'-UUUAAAGUCUUCUGAUGUCAUAUca-3'<br>3'-UAAAAUUUCAGAAGACUACAGUAUAGU-5'<br>Target: 5'-ATTTTAAAGTCTTCTGATGTCATATCA-3' | (SEQ ID NO: 2195)<br>(SEQ ID NO: 4209)<br>(SEQ ID NO: 6223) |
| LDHA-1295 | 5'-AAGUCUUCUGAUGUCAUAUCAUUtc-3'<br>3'-AUUUCAGAAGACUACAGUAUAGUAAAG-5'<br>Target: 5'-TAAAGTCTTCTGATGTCATATCATTTC-3' | (SEQ ID NO: 2196)<br>(SEQ ID NO: 4210)<br>(SEQ ID NO: 6224) |
| LDHA-1296 | 5'-AGUCUUCUGAUGUCAUAUCAUUUca-3'<br>3'-UUUCAGAAGACUACAGUAUAGUAAAGU-5'<br>Target: 5'-AAAGTCTTCTGATGTCATATCATTTCA-3' | (SEQ ID NO: 2197)<br>(SEQ ID NO: 4211)<br>(SEQ ID NO: 6225) |
| LDHA-1297 | 5'-GUCUUCUGAUGUCAUAUCAUUUCac-3'<br>3'-UUCAGAAGACUACAGUAUAGUAAAGUG-5'<br>Target: 5'-AAGTCTTCTGATGTCATATCATTTCAC-3' | (SEQ ID NO: 2198)<br>(SEQ ID NO: 4212)<br>(SEQ ID NO: 6226) |
| LDHA-1298 | 5'-UCUUCUGAUGUCAUAUCAUUUCAct-3'<br>3'-UCAGAAGACUACAGUAUAGUAAAGUGA-5'<br>Target: 5'-AGTCTTCTGATGTCATATCATTTCACT-3' | (SEQ ID NO: 2199)<br>(SEQ ID NO: 4213)<br>(SEQ ID NO: 6227) |
| LDHA-1299 | 5'-CUUCUGAUGUCAUAUCAUUUCACtg-3'<br>3'-CAGAAGACUACAGUAUAGUAAAGUGAC-5'<br>Target: 5'-GTCTTCTGATGTCATATCATTTCACTG-3' | (SEQ ID NO: 2200)<br>(SEQ ID NO: 4214)<br>(SEQ ID NO: 6228) |
| LDHA-1300 | 5'-UUCUGAUGUCAUAUCAUUUCACUgt-3'<br>3'-AGAAGACUACAGUAUAGUAAAGUGACA-5'<br>Target: 5'-TCTTCTGATGTCATATCATTTCACTGT-3' | (SEQ ID NO: 2201)<br>(SEQ ID NO: 4215)<br>(SEQ ID NO: 6229) |

TABLE 12-continued

Additional Selected Human Anti-Lactate Dehydrogenase DsiRNA Agents (Asymmetrics)

| | | |
|---|---|---|
| | 5'-UCUGAUGUCAUAUCAUUUCACUGtc-3' | (SEQ ID NO: 2202) |
| | 3'-GAAGACUACAGUAUAGUAAAGUGACAG-5' | (SEQ ID NO: 4216) |
| LDHA-1301 Target: | 5'-CTTCTGATGTCATATCATTTCACTGTC-3' | (SEQ ID NO: 6230) |
| | 5'-CUGAUGUCAUAUCAUUUCACUGUct-3' | (SEQ ID NO: 2203) |
| | 3'-AAGACUACAGUAUAGUAAAGUGACAGA-5' | (SEQ ID NO: 4217) |
| LDHA-1302 Target: | 5'-TTCTGATGTCATATCATTTCACTGTCT-3' | (SEQ ID NO: 6231) |
| | 5'-UGAUGUCAUAUCAUUUCACUGUCta-3' | (SEQ ID NO: 2204) |
| | 3'-AGACUACAGUAUAGUAAAGUGACAGAU-5' | (SEQ ID NO: 4218) |
| LDHA-1303 Target: | 5'-TCTGATGTCATATCATTTCACTGTCTA-3' | (SEQ ID NO: 6232) |
| | 5'-GAUGUCAUAUCAUUUCACUGUCUag-3' | (SEQ ID NO: 2205) |
| | 3'-GACUACAGUAUAGUAAAGUGACAGAUC-5' | (SEQ ID NO: 4219) |
| LDHA-1304 Target: | 5'-CTGATGTCATATCATTTCACTGTCTAG-3' | (SEQ ID NO: 6233) |
| | 5'-AUGUCAUAUCAUUUCACUGUCUAgg-3' | (SEQ ID NO: 2206) |
| | 3'-ACUACAGUAUAGUAAAGUGACAGAUCC-5' | (SEQ ID NO: 4220) |
| LDHA-1305 Target: | 5'-TGATGTCATATCATTTCACTGTCTAGG-3' | (SEQ ID NO: 6234) |
| | 5'-UGUCAUAUCAUUUCACUGUCUAGgc-3' | (SEQ ID NO: 2207) |
| | 3'-CUACAGUAUAGUAAAGUGACAGAUCCG-5' | (SEQ ID NO: 4221) |
| LDHA-1306 Target: | 5'-GATGTCATATCATTTCACTGTCTAGGC-3' | (SEQ ID NO: 6235) |
| | 5'-GUCAUAUCAUUUCACUGUCUAGGct-3' | (SEQ ID NO: 2208) |
| | 3'-UACAGUAUAGUAAAGUGACAGAUCCGA-5' | (SEQ ID NO: 4222) |
| LDHA-1307 Target: | 5'-ATGTCATATCATTTCACTGTCTAGGCT-3' | (SEQ ID NO: 6236) |
| | 5'-UCAUAUCAUUUCACUGUCUAGGCta-3' | (SEQ ID NO: 2209) |
| | 3'-ACAGUAUAGUAAAGUGACAGAUCCGAU-5' | (SEQ ID NO: 4223) |
| LDHA-1308 Target: | 5'-TGTCATATCATTTCACTGTCTAGGCTA-3' | (SEQ ID NO: 6237) |
| | 5'-CAUAUCAUUUCACUGUCUAGGCUac-3' | (SEQ ID NO: 2210) |
| | 3'-CAGUAUAGUAAAGUGACAGAUCCGAUG-5' | (SEQ ID NO: 4224) |
| LDHA-1309 Target: | 5'-GTCATATCATTTCACTGTCTAGGCTAC-3' | (SEQ ID NO: 6238) |
| | 5'-AUAUCAUUUCACUGUCUAGGCUAca-3' | (SEQ ID NO: 2211) |
| | 3'-AGUAUAGUAAAGUGACAGAUCCGAUGU-5' | (SEQ ID NO: 4225) |
| LDHA-1310 Target: | 5'-TCATATCATTTCACTGTCTAGGCTACA-3' | (SEQ ID NO: 6239) |
| | 5'-UAUCAUUUCACUGUCUAGGCUACaa-3' | (SEQ ID NO: 2212) |
| | 3'-GUAUAGUAAAGUGACAGAUCCGAUGUU-5' | (SEQ ID NO: 4226) |
| LDHA-1311 Target: | 5'-CATATCATTTCACTGTCTAGGCTACAA-3' | (SEQ ID NO: 6240) |
| | 5'-AUCAUUUCACUGUCUAGGCUACAac-3' | (SEQ ID NO: 2213) |
| | 3'-UAUAGUAAAGUGACAGAUCCGAUGUUG-5' | (SEQ ID NO: 4227) |
| LDHA-1312 Target: | 5'-ATATCATTTCACTGTCTAGGCTACAAC-3' | (SEQ ID NO: 6241) |
| | 5'-UCAUUUCACUGUCUAGGCUACAAca-3' | (SEQ ID NO: 2214) |
| | 3'-AUAGUAAAGUGACAGAUCCGAUGUUGU-5' | (SEQ ID NO: 4228) |
| LDHA-1313 Target: | 5'-TATCATTTCACTGTCTAGGCTACAACA-3' | (SEQ ID NO: 6242) |
| | 5'-CAUUUCACUGUCUAGGCUACAACag-3' | (SEQ ID NO: 2215) |
| | 3'-UAGUAAAGUGACAGAUCCGAUGUUGUC-5' | (SEQ ID NO: 4229) |
| LDHA-1314 Target: | 5'-ATCATTTCACTGTCTAGGCTACAACAG-3' | (SEQ ID NO: 6243) |
| | 5'-AUUUCACUGUCUAGGCUACAACAgg-3' | (SEQ ID NO: 2216) |
| | 3'-AGUAAAGUGACAGAUCCGAUGUUGUCC-5' | (SEQ ID NO: 4230) |
| LDHA-1315 Target: | 5'-TCATTTCACTGTCTAGGCTACAACAGG-3' | (SEQ ID NO: 6244) |
| | 5'-UUUCACUGUCUAGGCUACAACAGga-3' | (SEQ ID NO: 2217) |
| | 3'-GUAAAGUGACAGAUCCGAUGUUGUCCU-5' | (SEQ ID NO: 4231) |
| LDHA-1316 Target: | 5'-CATTTCACTGTCTAGGCTACAACAGGA-3' | (SEQ ID NO: 6245) |
| | 5'-UUCACUGUCUAGGCUACAACAGGat-3' | (SEQ ID NO: 2218) |
| | 3'-UAAAGUGACAGAUCCGAUGUUGUCCUA-5' | (SEQ ID NO: 4232) |
| LDHA-1317 Target: | 5'-ATTTCACTGTCTAGGCTACAACAGGAT-3' | (SEQ ID NO: 6246) |
| | 5'-UCACUGUCUAGGCUACAACAGGAtt-3' | (SEQ ID NO: 2219) |
| | 3'-AAAGUGACAGAUCCGAUGUUGUCCUAA-5' | (SEQ ID NO: 4233) |
| LDHA-1318 Target: | 5'-TTTCACTGTCTAGGCTACAACAGGATT-3' | (SEQ ID NO: 6247) |
| | 5'-CACUGUCUAGGCUACAACAGGAUtc-3' | (SEQ ID NO: 2220) |
| | 3'-AAGUGACAGAUCCGAUGUUGUCCUAAG-5' | (SEQ ID NO: 4234) |
| LDHA-1319 Target: | 5'-TTCACTGTCTAGGCTACAACAGGATTC-3' | (SEQ ID NO: 6248) |

TABLE 12-continued

Additional Selected Human Anti-Lactate Dehydrogenase DsiRNA Agents (Asymmetrics)

| | | |
|---|---|---|
| | 5'-ACUGUCUAGGCUACAACAGGAUUct-3' | (SEQ ID NO: 2221) |
| | 3'-AGUGACAGAUCCGAUGUUGUCCUAAGA-5' | (SEQ ID NO: 4235) |
| LDHA-1320 Target: | 5'-TCACTGTCTAGGCTACAACAGGATTCT-3' | (SEQ ID NO: 6249) |
| | 5'-CUGUCUAGGCUACAACAGGAUUCta-3' | (SEQ ID NO: 2222) |
| | 3'-GUGACAGAUCCGAUGUUGUCCUAAGAU-5' | (SEQ ID NO: 4236) |
| LDHA-1321 Target: | 5'-CACTGTCTAGGCTACAACAGGATTCTA-3' | (SEQ ID NO: 6250) |
| | 5'-UGUCUAGGCUACAACAGGAUUCUag-3' | (SEQ ID NO: 2223) |
| | 3'-UGACAGAUCCGAUGUUGUCCUAAGAUC-5' | (SEQ ID NO: 4237) |
| LDHA-1322 Target: | 5'-ACTGTCTAGGCTACAACAGGATTCTAG-3' | (SEQ ID NO: 6251) |
| | 5'-GUCUAGGCUACAACAGGAUUCUAgg-3' | (SEQ ID NO: 2224) |
| | 3'-GACAGAUCCGAUGUUGUCCUAAGAUCC-5' | (SEQ ID NO: 4238) |
| LDHA-1323 Target: | 5'-CTGTCTAGGCTACAACAGGATTCTAGG-3' | (SEQ ID NO: 6252) |
| | 5'-UCUAGGCUACAACAGGAUUCUAGgt-3' | (SEQ ID NO: 2225) |
| | 3'-ACAGAUCCGAUGUUGUCCUAAGAUCCA-5' | (SEQ ID NO: 4239) |
| LDHA-1324 Target: | 5'-TGTCTAGGCTACAACAGGATTCTAGGT-3' | (SEQ ID NO: 6253) |
| | 5'-CUAGGCUACAACAGGAUUCUAGGtg-3' | (SEQ ID NO: 2226) |
| | 3'-CAGAUCCGAUGUUGUCCUAAGAUCCAC-5' | (SEQ ID NO: 4240) |
| LDHA-1325 Target: | 5'-GTCTAGGCTACAACAGGATTCTAGGTG-3' | (SEQ ID NO: 6254) |
| | 5'-UAGGCUACAACAGGAUUCUAGGUgg-3' | (SEQ ID NO: 2227) |
| | 3'-AGAUCCGAUGUUGUCCUAAGAUCCACC-5' | (SEQ ID NO: 4241) |
| LDHA-1326 Target: | 5'-TCTAGGCTACAACAGGATTCTAGGTGG-3' | (SEQ ID NO: 6255) |
| | 5'-AGGCUACAACAGGAUUCUAGGUGga-3' | (SEQ ID NO: 2228) |
| | 3'-GAUCCGAUGUUGUCCUAAGAUCCACCU-5' | (SEQ ID NO: 4242) |
| LDHA-1327 Target: | 5'-CTAGGCTACAACAGGATTCTAGGTGGA-3' | (SEQ ID NO: 6256) |
| | 5'-GGCUACAACAGGAUUCUAGGUGGag-3' | (SEQ ID NO: 2229) |
| | 3'-AUCCGAUGUUGUCCUAAGAUCCACCUC-5' | (SEQ ID NO: 4243) |
| LDHA-1328 Target: | 5'-TAGGCTACAACAGGATTCTAGGTGGAG-3' | (SEQ ID NO: 6257) |
| | 5'-GCUACAACAGGAUUCUAGGUGGAgg-3' | (SEQ ID NO: 2230) |
| | 3'-UCCGAUGUUGUCCUAAGAUCCACCUCC-5' | (SEQ ID NO: 4244) |
| LDHA-1329 Target: | 5'-AGGCTACAACAGGATTCTAGGTGGAGG-3' | (SEQ ID NO: 6258) |
| | 5'-CUACAACAGGAUUCUAGGUGGAGgt-3' | (SEQ ID NO: 2231) |
| | 3'-CCGAUGUUGUCCUAAGAUCCACCUCCA-5' | (SEQ ID NO: 4245) |
| LDHA-1330 Target: | 5'-GGCTACAACAGGATTCTAGGTGGAGGT-3' | (SEQ ID NO: 6259) |
| | 5'-UACAACAGGAUUCUAGGUGGAGGtt-3' | (SEQ ID NO: 2232) |
| | 3'-CGAUGUUGUCCUAAGAUCCACCUCCAA-5' | (SEQ ID NO: 4246) |
| LDHA-1331 Target: | 5'-GCTACAACAGGATTCTAGGTGGAGGTT-3' | (SEQ ID NO: 6260) |
| | 5'-ACAACAGGAUUCUAGGUGGAGGUtg-3' | (SEQ ID NO: 2233) |
| | 3'-GAUGUUGUCCUAAGAUCCACCUCCAAC-5' | (SEQ ID NO: 4247) |
| LDHA-1332 Target: | 5'-CTACAACAGGATTCTAGGTGGAGGTTG-3' | (SEQ ID NO: 6261) |
| | 5'-CAACAGGAUUCUAGGUGGAGGUUgt-3' | (SEQ ID NO: 2234) |
| | 3'-AUGUUGUCCUAAGAUCCACCUCCAACA-5' | (SEQ ID NO: 4248) |
| LDHA-1333 Target: | 5'-TACAACAGGATTCTAGGTGGAGGTTGT-3' | (SEQ ID NO: 6262) |
| | 5'-AACAGGAUUCUAGGUGGAGGUUGtg-3' | (SEQ ID NO: 2235) |
| | 3'-UGUUGUCCUAAGAUCCACCUCCAACAC-5' | (SEQ ID NO: 4249) |
| LDHA-1334 Target: | 5'-ACAACAGGATTCTAGGTGGAGGTTGTG-3' | (SEQ ID NO: 6263) |
| | 5'-ACAGGAUUCUAGGUGGAGGUUGUgc-3' | (SEQ ID NO: 2236) |
| | 3'-GUUGUCCUAAGAUCCACCUCCAACACG-5' | (SEQ ID NO: 4250) |
| LDHA-1335 Target: | 5'-CAACAGGATTCTAGGTGGAGGTTGTGC-3' | (SEQ ID NO: 6264) |
| | 5'-CAGGAUUCUAGGUGGAGGUUGUGca-3' | (SEQ ID NO: 2237) |
| | 3'-UUGUCCUAAGAUCCACCUCCAACACGU-5' | (SEQ ID NO: 4251) |
| LDHA-1336 Target: | 5'-AACAGGATTCTAGGTGGAGGTTGTGCA-3' | (SEQ ID NO: 6265) |
| | 5'-AGGAUUCUAGGUGGAGGUUGUGCat-3' | (SEQ ID NO: 2238) |
| | 3'-UGUCCUAAGAUCCACCUCCAACACGUA-5' | (SEQ ID NO: 4252) |
| LDHA-1337 Target: | 5'-ACAGGATTCTAGGTGGAGGTTGTGCAT-3' | (SEQ ID NO: 6266) |
| | 5'-GGAUUCUAGGUGGAGGUUGUGCAtg-3' | (SEQ ID NO: 2239) |
| | 3'-GUCCUAAGAUCCACCUCCAACACGUAC-5' | (SEQ ID NO: 4253) |
| LDHA-1338 Target: | 5'-CAGGATTCTAGGTGGAGGTTGTGCATG-3' | (SEQ ID NO: 6267) |

TABLE 12-continued

Additional Selected Human Anti-Lactate Dehydrogenase DsiRNA Agents (Asymmetrics)

|  |  |  |  |
|---|---|---|---|
| LDHA-1339 | 5'-GAUUCUAGGUGGAGGUUGUGCAUgt-3'<br>3'-UCCUAAGAUCCACCUCCAACACGUACA-5'<br>Target: 5'-AGGATTCTAGGTGGAGGTTGTGCATGT-3' | (SEQ ID NO: 2240)<br>(SEQ ID NO: 4254)<br>(SEQ ID NO: 6268) | |
| LDHA-1340 | 5'-AUUCUAGGUGGAGGUUGUGCAUGtt-3'<br>3'-CCUAAGAUCCACCUCCAACACGUACAA-5'<br>Target: 5'-GGATTCTAGGTGGAGGTTGTGCATGTT-3' | (SEQ ID NO: 2241)<br>(SEQ ID NO: 4255)<br>(SEQ ID NO: 6269) | |
| LDHA-1341 | 5'-UUCUAGGUGGAGGUUGUGCAUGUtg-3'<br>3'-CUAAGAUCCACCUCCAACACGUACAAC-5'<br>Target: 5'-GATTCTAGGTGGAGGTTGTGCATGTTG-3' | (SEQ ID NO: 2242)<br>(SEQ ID NO: 4256)<br>(SEQ ID NO: 6270) | |
| LDHA-1342 | 5'-UCUAGGUGGAGGUUGUGCAUGUUgt-3'<br>3'-UAAGAUCCACCUCCAACACGUACAACA-5'<br>Target: 5'-ATTCTAGGTGGAGGTTGTGCATGTTGT-3' | (SEQ ID NO: 2243)<br>(SEQ ID NO: 4257)<br>(SEQ ID NO: 6271) | |
| LDHA-1343 | 5'-CUAGGUGGAGGUUGUGCAUGUUGtc-3'<br>3'-AAGAUCCACCUCCAACACGUACAACAG-5'<br>Target: 5'-TTCTAGGTGGAGGTTGTGCATGTTGTC-3' | (SEQ ID NO: 2244)<br>(SEQ ID NO: 4258)<br>(SEQ ID NO: 6272) | |
| LDHA-1344 | 5'-UAGGUGGAGGUUGUGCAUGUUGUcc-3'<br>3'-AGAUCCACCUCCAACACGUACAACAGG-5'<br>Target: 5'-TCTAGGTGGAGGTTGTGCATGTTGTCC-3' | (SEQ ID NO: 2245)<br>(SEQ ID NO: 4259)<br>(SEQ ID NO: 6273) | |
| LDHA-1345 | 5'-AGGUGGAGGUUGUGCAUGUUGUCct-3'<br>3'-GAUCCACCUCCAACACGUACAACAGGA-5'<br>Target: 5'-CTAGGTGGAGGTTGTGCATGTTGTCCT-3' | (SEQ ID NO: 2246)<br>(SEQ ID NO: 4260)<br>(SEQ ID NO: 6274) | |
| LDHA-1346 | 5'-GGUGGAGGUUGUGCAUGUUGUCCtt-3'<br>3'-AUCCACCUCCAACACGUACAACAGGAA-5'<br>Target: 5'-TAGGTGGAGGTTGTGCATGTTGTCCTT-3' | (SEQ ID NO: 2247)<br>(SEQ ID NO: 4261)<br>(SEQ ID NO: 6275) | |
| LDHA-1347 | 5'-GUGGAGGUUGUGCAUGUUGUCCUtt-3'<br>3'-UCCACCUCCAACACGUACAACAGGAAA-5'<br>Target: 5'-AGGTGGAGGTTGTGCATGTTGTCCTTT-3' | (SEQ ID NO: 2248)<br>(SEQ ID NO: 4262)<br>(SEQ ID NO: 6276) | |
| LDHA-1348 | 5'-UGGAGGUUGUGCAUGUUGUCCUUtt-3'<br>3'-CCACCUCCAACACGUACAACAGGAAAA-5'<br>Target: 5'-GGTGGAGGTTGTGCATGTTGTCCTTTT-3' | (SEQ ID NO: 2249)<br>(SEQ ID NO: 4263)<br>(SEQ ID NO: 6277) | |
| LDHA-1349 | 5'-GGAGGUUGUGCAUGUUGUCCUUUtt-3'<br>3'-CACCUCCAACACGUACAACAGGAAAAA-5'<br>Target: 5'-GTGGAGGTTGTGCATGTTGTCCTTTTT-3' | (SEQ ID NO: 2250)<br>(SEQ ID NO: 4264)<br>(SEQ ID NO: 6278) | |
| LDHA-1350 | 5'-GAGGUUGUGCAUGUUGUCCUUUUta-3'<br>3'-ACCUCCAACACGUACAACAGGAAAAAU-5'<br>Target: 5'-TGGAGGTTGTGCATGTTGTCCTTTTTA-3' | (SEQ ID NO: 2251)<br>(SEQ ID NO: 4265)<br>(SEQ ID NO: 6279) | |
| LDHA-1351 | 5'-AGGUUGUGCAUGUUGUCCUUUUUat-3'<br>3'-CCUCCAACACGUACAACAGGAAAAAUA-5'<br>Target: 5'-GGAGGTTGTGCATGTTGTCCTTTTTAT-3' | (SEQ ID NO: 2252)<br>(SEQ ID NO: 4266)<br>(SEQ ID NO: 6280) | |
| LDHA-1352 | 5'-GGUUGUGCAUGUUGUCCUUUUUAtc-3'<br>3'-CUCCAACACGUACAACAGGAAAAAUAG-5'<br>Target: 5'-GAGGTTGTGCATGTTGTCCTTTTTATC-3' | (SEQ ID NO: 2253)<br>(SEQ ID NO: 4267)<br>(SEQ ID NO: 6281) | |
| LDHA-1353 | 5'-GUUGUGCAUGUUGUCCUUUUUAUct-3'<br>3'-UCCAACACGUACAACAGGAAAAAUAGA-5'<br>Target: 5'-AGGTTGTGCATGTTGTCCTTTTTATCT-3' | (SEQ ID NO: 2254)<br>(SEQ ID NO: 4268)<br>(SEQ ID NO: 6282) | |
| LDHA-1354 | 5'-UUGUGCAUGUUGUCCUUUUUAUCtg-3'<br>3'-CCAACACGUACAACAGGAAAAAUAGAC-5'<br>Target: 5'-GGTTGTGCATGTTGTCCTTTTTATCTG-3' | (SEQ ID NO: 2255)<br>(SEQ ID NO: 4269)<br>(SEQ ID NO: 6283) | |
| LDHA-1355 | 5'-UGUGCAUGUUGUCCUUUUUAUCUga-3'<br>3'-CAACACGUACAACAGGAAAAAUAGACU-5'<br>Target: 5'-GTTGTGCATGTTGTCCTTTTTATCTGA-3' | (SEQ ID NO: 2256)<br>(SEQ ID NO: 4270)<br>(SEQ ID NO: 6284) | |
| LDHA-1356 | 5'-GUGCAUGUUGUCCUUUUUAUCUGat-3'<br>3'-AACACGUACAACAGGAAAAAUAGACUA-5'<br>Target: 5'-TTGTGCATGTTGTCCTTTTTATCTGAT-3' | (SEQ ID NO: 2257)<br>(SEQ ID NO: 4271)<br>(SEQ ID NO: 6285) | |
| LDHA-1357 | 5'-UGCAUGUUGUCCUUUUUAUCUGAtc-3'<br>3'-ACACGUACAACAGGAAAAAUAGACUAG-5'<br>Target: 5'-TGTGCATGTTGTCCTTTTTATCTGATC-3' | (SEQ ID NO: 2258)<br>(SEQ ID NO: 4272)<br>(SEQ ID NO: 6286) | |

TABLE 12-continued

Additional Selected Human Anti-Lactate Dehydrogenase DsiRNA Agents (Asymmetrics)

| | | |
|---|---|---|
| | 5'-GCAUGUUGUCCUUUUUAUCUGAUct-3' | (SEQ ID NO: 2259) |
| | 3'-CACGUACAACAGGAAAAAUAGACUAGA-5' | (SEQ ID NO: 4273) |
| LDHA-1358 Target: | 5'-GTGCATGTTGTCCTTTTTATCTGATCT-3' | (SEQ ID NO: 6287) |
| | 5'-UGUCCUUUUUAUCUGAUCUGUGAtt-3' | (SEQ ID NO: 2260) |
| | 3'-CAACAGGAAAAAUAGACUAGACACUAA-5' | (SEQ ID NO: 4274) |
| LDHA-1364 Target: | 5'-GTTGTCCTTTTTATCTGATCTGTGATT-3' | (SEQ ID NO: 6288) |
| | 5'-UUUUUAUCUGAUCUGUGAUUAAAgc-3' | (SEQ ID NO: 2261) |
| | 3'-GGAAAAAUAGACUAGACACUAAUUUCG-5' | (SEQ ID NO: 4275) |
| LDHA-1369 Target: | 5'-CCTTTTTATCTGATCTGTGATTAAAGC-3' | (SEQ ID NO: 6289) |
| | 5'-UAUCUGAUCUGUGAUUAAAGCAGta-3' | (SEQ ID NO: 2262) |
| | 3'-AAAUAGACUAGACACUAAUUUCGUCAU-5' | (SEQ ID NO: 4276) |
| LDHA-1373 Target: | 5'-TTTATCTGATCTGTGATTAAAGCAGTA-3' | (SEQ ID NO: 6290) |
| | 5'-AUCUGAUCUGUGAUUAAAGCAGUaa-3' | (SEQ ID NO: 2263) |
| | 3'-AAUAGACUAGACACUAAUUUCGUCAUU-5' | (SEQ ID NO: 4277) |
| LDHA-1374 Target: | 5'-TTATCTGATCTGTGATTAAAGCAGTAA-3' | (SEQ ID NO: 6291) |
| | 5'-UCUGAUCUGUGAUUAAAGCAGUAat-3' | (SEQ ID NO: 2264) |
| | 3'-AUAGACUAGACACUAAUUUCGUCAUUA-5' | (SEQ ID NO: 4278) |
| LDHA-1375 Target: | 5'-TATCTGATCTGTGATTAAAGCAGTAAT-3' | (SEQ ID NO: 6292) |
| | 5'-CUGAUCUGUGAUUAAAGCAGUAAta-3' | (SEQ ID NO: 2265) |
| | 3'-UAGACUAGACACUAAUUUCGUCAUUAU-5' | (SEQ ID NO: 4279) |
| LDHA-1376 Target: | 5'-ATCTGATCTGTGATTAAAGCAGTAATA-3' | (SEQ ID NO: 6293) |
| | 5'-UGAUCUGUGAUUAAAGCAGUAAUat-3' | (SEQ ID NO: 2266) |
| | 3'-AGACUAGACACUAAUUUCGUCAUUAUA-5' | (SEQ ID NO: 4280) |
| LDHA-1377 Target: | 5'-TCTGATCTGTGATTAAAGCAGTAATAT-3' | (SEQ ID NO: 6294) |
| | 5'-GAUCUGUGAUUAAAGCAGUAAUAtt-3' | (SEQ ID NO: 2267) |
| | 3'-GACUAGACACUAAUUUCGUCAUUAUAA-5' | (SEQ ID NO: 4281) |
| LDHA-1378 Target: | 5'-CTGATCTGTGATTAAAGCAGTAATATT-3' | (SEQ ID NO: 6295) |
| | 5'-AUCUGUGAUUAAAGCAGUAAUAUtt-3' | (SEQ ID NO: 2268) |
| | 3'-ACUAGACACUAAUUUCGUCAUUAUAAA-5' | (SEQ ID NO: 4282) |
| LDHA-1379 Target: | 5'-TGATCTGTGATTAAAGCAGTAATATTT-3' | (SEQ ID NO: 6296) |
| | 5'-UCUGUGAUUAAAGCAGUAAUAUUtt-3' | (SEQ ID NO: 2269) |
| | 3'-CUAGACACUAAUUUCGUCAUUAUAAAA-5' | (SEQ ID NO: 4283) |
| LDHA-1380 Target: | 5'-GATCTGTGATTAAAGCAGTAATATTTT-3' | (SEQ ID NO: 6297) |
| | 5'-CUGUGAUUAAAGCAGUAAUAUUUta-3' | (SEQ ID NO: 2270) |
| | 3'-UAGACACUAAUUUCGUCAUUAUAAAAU-5' | (SEQ ID NO: 4284) |
| LDHA-1381 Target: | 5'-ATCTGTGATTAAAGCAGTAATATTTTA-3' | (SEQ ID NO: 6298) |
| | 5'-UGUGAUUAAAGCAGUAAUAUUUUaa-3' | (SEQ ID NO: 2271) |
| | 3'-AGACACUAAUUUCGUCAUUAUAAAAUU-5' | (SEQ ID NO: 4285) |
| LDHA-1382 Target: | 5'-TCTGTGATTAAAGCAGTAATATTTTAA-3' | (SEQ ID NO: 6299) |
| | 5'-GUGAUUAAAGCAGUAAUAUUUUAag-3' | (SEQ ID NO: 2272) |
| | 3'-GACACUAAUUUCGUCAUUAUAAAAUUC-5' | (SEQ ID NO: 4286) |
| LDHA-1383 Target: | 5'-CTGTGATTAAAGCAGTAATATTTTAAG-3' | (SEQ ID NO: 6300) |
| | 5'-UGAUUAAAGCAGUAAUAUUUUAAga-3' | (SEQ ID NO: 2273) |
| | 3'-ACACUAAUUUCGUCAUUAUAAAAUUCU-5' | (SEQ ID NO: 4287) |
| LDHA-1384 Target: | 5'-TGTGATTAAAGCAGTAATATTTTAAGA-3' | (SEQ ID NO: 6301) |
| | 5'-GAUUAAAGCAGUAAUAUUUUAAGat-3' | (SEQ ID NO: 2274) |
| | 3'-CACUAAUUUCGUCAUUAUAAAAUUCUA-5' | (SEQ ID NO: 4288) |
| LDHA-1385 Target: | 5'-GTGATTAAAGCAGTAATATTTTAAGAT-3' | (SEQ ID NO: 6302) |
| | 5'-AUUAAAGCAGUAAUAUUUUAAGAtg-3' | (SEQ ID NO: 2275) |
| | 3'-ACUAAUUUCGUCAUUAUAAAAUUCUAC-5' | (SEQ ID NO: 4289) |
| LDHA-1386 Target: | 5'-TGATTAAAGCAGTAATATTTTAAGATG-3' | (SEQ ID NO: 6303) |
| | 5'-UUAAAGCAGUAAUAUUUUAAGAUgg-3' | (SEQ ID NO: 2276) |
| | 3'-CUAAUUUCGUCAUUAUAAAAUUCUACC-5' | (SEQ ID NO: 4290) |
| LDHA-1387 Target: | 5'-GATTAAAGCAGTAATATTTTAAGATGG-3' | (SEQ ID NO: 6304) |
| | 5'-UAAAGCAGUAAUAUUUUAAGAUGga-3' | (SEQ ID NO: 2277) |
| | 3'-UAAUUUCGUCAUUAUAAAAUUCUACCU-5' | (SEQ ID NO: 4291) |
| LDHA-1388 Target: | 5'-ATTAAAGCAGTAATATTTTAAGATGGA-3' | (SEQ ID NO: 6305) |

TABLE 12-continued

Additional Selected Human Anti-Lactate Dehydrogenase DsiRNA Agents (Asymmetrics)

|  |  |  |
|---|---|---|
|  | 5'-A<u>AA</u>GCAGUAAUAU<u>UUU</u>AAGAUGGac-3' | (SEQ ID NO: 2278) |
|  | 3'-<u>AAUUU</u>CGUCAUUAU<u>AAAA</u>UUCUA<u>CCUG</u>-5' | (SEQ ID NO: 4292) |
| LDHA-1389 Target: | 5'-TTAAAGCAGTAATATTTTAAGATGGAC-3' | (SEQ ID NO: 6306) |
|  | 5'-A<u>AG</u>CAGUAAUAUUU<u>U</u>AAGAUGGAct-3' | (SEQ ID NO: 2279) |
|  | 3'-<u>AUUU</u>CGUCAUUAUA<u>AAA</u>UUCUA<u>CUGA</u>-5' | (SEQ ID NO: 4293) |
| LDHA-1390 Target: | 5'-TAAAGCAGTAATATTTTAAGATGGACT-3' | (SEQ ID NO: 6307) |
|  | 5'-A<u>G</u>CAGUAAUAUUUU<u>AA</u>GAUGGACtg-3' | (SEQ ID NO: 2280) |
|  | 3'-<u>UUU</u>CGUCAUUAUAA<u>AA</u>UUCUACC<u>UGAC</u>-5' | (SEQ ID NO: 4294) |
| LDHA-1391 Target: | 5'-AAAGCAGTAATATTTTAAGATGGACTG-3' | (SEQ ID NO: 6308) |
|  | 5'-G<u>CA</u>GUAAUAUUUU<u>AA</u>GAUGGACUgg-3' | (SEQ ID NO: 2281) |
|  | 3'-<u>UUC</u>GUCAUUAUAAA<u>A</u>UUCUACCUG<u>ACC</u>-5' | (SEQ ID NO: 4295) |
| LDHA-1392 Target: | 5'-AAGCAGTAATATTTTAAGATGGACTGG-3' | (SEQ ID NO: 6309) |
|  | 5'-A<u>GU</u>AAUAUUUUAA<u>GA</u>UGGACUGGga-3' | (SEQ ID NO: 2282) |
|  | 3'-<u>C</u>GUC<u>A</u>UUAUAAAAU<u>U</u>C<u>U</u>ACCUGA<u>CCCU</u>-5' | (SEQ ID NO: 4296) |
| LDHA-1394 Target: | 5'-GCAGTAATATTTTAAGATGGACTGGGA-3' | (SEQ ID NO: 6310) |
|  | 5'-G<u>UA</u>AUAUUUAAGA<u>U</u>GGACUGGGaa-3' | (SEQ ID NO: 2283) |
|  | 3'-<u>GUC</u>AUUAUAAAAUU<u>C</u>UACCUGA<u>CCUU</u>-5' | (SEQ ID NO: 4297) |
| LDHA-1395 Target: | 5'-CAGTAATATTTTAAGATGGACTGGGAA-3' | (SEQ ID NO: 6311) |
|  | 5'-U<u>AA</u>UAUUUUAAGAU<u>GG</u>ACUGGGAaa-3' | (SEQ ID NO: 2284) |
|  | 3'-<u>UCA</u>UU<u>AUAAAAUUCU</u>ACCUGA<u>CCCUUU</u>-5' | (SEQ ID NO: 4298) |
| LDHA-1396 Target: | 5'-AGTAATATTTTAAGATGGACTGGGAAA-3' | (SEQ ID NO: 6312) |
|  | 5'-A<u>AU</u>AUUUUAAGAUGG<u>A</u>CUGGGAAaa-3' | (SEQ ID NO: 2285) |
|  | 3'-<u>CAUU</u>AUAAAAUUCUA<u>C</u>CUGACCC<u>UUUU</u>-5' | (SEQ ID NO: 4299) |
| LDHA-1397 Target: | 5'-GTAATATTTTAAGATGGACTGGGAAAA-3' | (SEQ ID NO: 6313) |
|  | 5'-A<u>UA</u>UUUUAAGAUGG<u>A</u>CUGGGAAAaa-3' | (SEQ ID NO: 2286) |
|  | 3'-<u>AUUA</u>UA<u>AAAUUCUA</u>CCUGACCC<u>UUUUU</u>-5' | (SEQ ID NO: 4300) |
| LDHA-1398 Target: | 5'-TAATATTTTAAGATGGACTGGGAAAAA-3' | (SEQ ID NO: 6314) |
|  | 5'-U<u>A</u>UUUUAAGAUGGA<u>CU</u>GGGAAAAac-3' | (SEQ ID NO: 2287) |
|  | 3'-<u>UUAU</u>AAAAUUCUA<u>CC</u>UGACCCUU<u>UUUG</u>-5' | (SEQ ID NO: 4301) |
| LDHA-1399 Target: | 5'-AATATTTTAAGATGGACTGGGAAAAAC-3' | (SEQ ID NO: 6315) |
|  | 5'-A<u>U</u>UUUAAGAUGGAC<u>U</u>GGGAAAAAca-3' | (SEQ ID NO: 2288) |
|  | 3'-<u>UAU</u>AAAAUUCUA<u>CC</u>UGACCCUUU<u>UUGU</u>-5' | (SEQ ID NO: 4302) |
| LDHA-1400 Target: | 5'-ATATTTTAAGATGGACTGGGAAAAACA-3' | (SEQ ID NO: 6316) |
|  | 5'-U<u>UUU</u>AAGAUGGACU<u>G</u>GGAAAAACat-3' | (SEQ ID NO: 2289) |
|  | 3'-<u>AUAAAA</u>UUCUACCUGA<u>C</u>CCUUUUU<u>GUA</u>-5' | (SEQ ID NO: 4303) |
| LDHA-1401 Target: | 5'-TATTTTAAGATGGACTGGGAAAAACAT-3' | (SEQ ID NO: 6317) |
|  | 5'-U<u>UU</u>AAGAUGGACU<u>GGG</u>AAAAACAtc-3' | (SEQ ID NO: 2290) |
|  | 3'-<u>UAAAA</u>UUCUACCUGA<u>CCC</u>UUUUUG<u>UAG</u>-5' | (SEQ ID NO: 4304) |
| LDHA-1402 Target: | 5'-ATTTTAAGATGGACTGGGAAAAACATC-3' | (SEQ ID NO: 6318) |
|  | 5'-U<u>U</u>AAGAUGGACUGG<u>G</u>AAAAACAUca-3' | (SEQ ID NO: 2291) |
|  | 3'-<u>AAAA</u>UUCUACCUGA<u>CCC</u>UUUUUGU<u>AGU</u>-5' | (SEQ ID NO: 4305) |
| LDHA-1403 Target: | 5'-TTTTAAGATGGACTGGGAAAAACATCA-3' | (SEQ ID NO: 6319) |
|  | 5'-U<u>AA</u>GAUGGACUGGG<u>A</u>AAAACAUCaa-3' | (SEQ ID NO: 2292) |
|  | 3'-<u>AAA</u>UUCUACCUGA<u>CCC</u>UUUUUGU<u>AGUU</u>-5' | (SEQ ID NO: 4306) |
| LDHA-1404 Target: | 5'-TTTAAGATGGACTGGGAAAAACATCAA-3' | (SEQ ID NO: 6320) |
|  | 5'-A<u>AG</u>AUGGACUGGG<u>AAA</u>AACAUCAac-3' | (SEQ ID NO: 2293) |
|  | 3'-<u>AA</u>UUCUACCUGACC<u>C</u>UUUUUGUA<u>GUUG</u>-5' | (SEQ ID NO: 4307) |
| LDHA-1405 Target: | 5'-TTAAGATGGACTGGGAAAAACATCAAC-3' | (SEQ ID NO: 6321) |
|  | 5'-A<u>GA</u>UGGACUGGGA<u>AAAA</u>CAUCAAct-3' | (SEQ ID NO: 2294) |
|  | 3'-<u>AU</u>UCUACCUGACCC<u>UUUUU</u>GUAG<u>UUGA</u>-5' | (SEQ ID NO: 4308) |
| LDHA-1406 Target: | 5'-TAAGATGGACTGGGAAAAACATCAACT-3' | (SEQ ID NO: 6322) |
|  | 5'-G<u>A</u>UGGACUGGGAAAAA<u>C</u>AUCAACtc-3' | (SEQ ID NO: 2295) |
|  | 3'-<u>UUC</u>U<u>A</u>CCUGACCCUUUUUGUAGUU<u>GAG</u>-5' | (SEQ ID NO: 4309) |
| LDHA-1407 Target: | 5'-AAGATGGACTGGGAAAAACATCAACTC-3' | (SEQ ID NO: 6323) |
|  | 5'-A<u>U</u>GGACUGGG<u>AAAA</u>CAUCAACUcc-3' | (SEQ ID NO: 2296) |
|  | 3'-<u>UCUA</u>CCUGACCC<u>UUUUU</u>GUAGUU<u>GAGG</u>-5' | (SEQ ID NO: 4310) |
| LDHA-1408 Target: | 5'-AGATGGACTGGGAAAAACATCAACTCC-3' | (SEQ ID NO: 6324) |

TABLE 12-continued

Additional Selected Human Anti-Lactate Dehydrogenase DsiRNA Agents (Asymmetrics)

|  |  |  |
|---|---|---|
| LDHA-1409 Target: | 5'-UGGACUGGGAAAAACAUCAACUCCct-3'<br>3'-CUACCUGACCCUUUUUGUAGUUGAGGA-5'<br>5'-GATGGACTGGGAAAAACATCAACTCCT-3' | (SEQ ID NO: 2297)<br>(SEQ ID NO: 4311)<br>(SEQ ID NO: 6325) |
| LDHA-1410 Target: | 5'-GGACUGGGAAAAACAUCAACUCCtg-3'<br>3'-UACCUGACCCUUUUUGUAGUUGAGGAC-5'<br>5'-ATGGACTGGGAAAAACATCAACTCCTG-3' | (SEQ ID NO: 2298)<br>(SEQ ID NO: 4312)<br>(SEQ ID NO: 6326) |
| LDHA-1411 Target: | 5'-GACUGGGAAAAACAUCAACUCCUga-3'<br>3'-ACCUGACCCUUUUUGUAGUUGAGGACU-5'<br>5'-TGGACTGGGAAAAACATCAACTCCTGA-3' | (SEQ ID NO: 2299)<br>(SEQ ID NO: 4313)<br>(SEQ ID NO: 6327) |
| LDHA-1412 Target: | 5'-ACUGGGAAAAACAUCAACUCCUGaa-3'<br>3'-CCUGACCCUUUUUGUAGUUGAGGACUU-5'<br>5'-GGACTGGGAAAAACATCAACTCCTGAA-3' | (SEQ ID NO: 2300)<br>(SEQ ID NO: 4314)<br>(SEQ ID NO: 6328) |
| LDHA-1413 Target: | 5'-CUGGGAAAAACAUCAACUCCUGAag-3'<br>3'-CUGACCCUUUUUGUAGUUGAGGACUUC-5'<br>5'-GACTGGGAAAAACATCAACTCCTGAAG-3' | (SEQ ID NO: 2301)<br>(SEQ ID NO: 4315)<br>(SEQ ID NO: 6329) |
| LDHA-1414 Target: | 5'-UGGGAAAAACAUCAACUCCUGAAgt-3'<br>3'-UGACCCUUUUUGUAGUUGAGGACUUCA-5'<br>5'-ACTGGGAAAAACATCAACTCCTGAAGT-3' | (SEQ ID NO: 2302)<br>(SEQ ID NO: 4316)<br>(SEQ ID NO: 6330) |
| LDHA-1415 Target: | 5'-GGGAAAAACAUCAACUCCUGAAGtt-3'<br>3'-GACCCUUUUUGUAGUUGAGGACUUCAA-5'<br>5'-CTGGGAAAAACATCAACTCCTGAAGTT-3' | (SEQ ID NO: 2303)<br>(SEQ ID NO: 4317)<br>(SEQ ID NO: 6331) |
| LDHA-1416 Target: | 5'-GGAAAAACAUCAACUCCUGAAGUta-3'<br>3'-ACCCUUUUUGUAGUUGAGGACUUCAAU-5'<br>5'-TGGAAAAACATCAACTCCTGAAGTTA-3' | (SEQ ID NO: 2304)<br>(SEQ ID NO: 4318)<br>(SEQ ID NO: 6332) |
| LDHA-1417 Target: | 5'-GAAAAACAUCAACUCCUGAAGUUag-3'<br>3'-CCCUUUUUGUAGUUGAGGACUUCAAUC-5'<br>5'-GGGAAAAACATCAACTCCTGAAGTTAG-3' | (SEQ ID NO: 2305)<br>(SEQ ID NO: 4319)<br>(SEQ ID NO: 6333) |
| LDHA-1418 Target: | 5'-AAAAACAUCAACUCCUGAAGUUAga-3'<br>3'-CCUUUUUGUAGUUGAGGACUUCAAUCU-5'<br>5'-GGAAAAACATCAACTCCTGAAGTTAGA-3' | (SEQ ID NO: 2306)<br>(SEQ ID NO: 4320)<br>(SEQ ID NO: 6334) |
| LDHA-1419 Target: | 5'-AAAACAUCAACUCCUGAAGUUAGaa-3'<br>3'-CUUUUUGUAGUUGAGGACUUCAAUCUU-5'<br>5'-GAAAAACATCAACTCCTGAAGTTAGAA-3' | (SEQ ID NO: 2307)<br>(SEQ ID NO: 4321)<br>(SEQ ID NO: 6335) |
| LDHA-1420 Target: | 5'-AAACAUCAACUCCUGAAGUUAGAaa-3'<br>3'-UUUUUGUAGUUGAGGACUUCAAUCUUU-5'<br>5'-AAAAACATCAACTCCTGAAGTTAGAAA-3' | (SEQ ID NO: 2308)<br>(SEQ ID NO: 4322)<br>(SEQ ID NO: 6336) |
| LDHA-1421 Target: | 5'-AACAUCAACUCCUGAAGUUAGAAat-3'<br>3'-UUUUGUAGUUGAGGACUUCAAUCUUUA-5'<br>5'-AAAACATCAACTCCTGAAGTTAGAAAT-3' | (SEQ ID NO: 2309)<br>(SEQ ID NO: 4323)<br>(SEQ ID NO: 6337) |
| LDHA-1422 Target: | 5'-ACAUCAACUCCUGAAGUUAGAAAta-3'<br>3'-UUUGUAGUUGAGGACUUCAAUCUUUAU-5'<br>5'-AAACATCAACTCCTGAAGTTAGAAATA-3' | (SEQ ID NO: 2310)<br>(SEQ ID NO: 4324)<br>(SEQ ID NO: 6338) |
| LDHA-1423 Target: | 5'-CAUCAACUCCUGAAGUUAGAAAUaa-3'<br>3'-UUGUAGUUGAGGACUUCAAUCUUUAUU-5'<br>5'-AACATCAACTCCTGAAGTTAGAAATAA-3' | (SEQ ID NO: 2311)<br>(SEQ ID NO: 4325)<br>(SEQ ID NO: 6339) |
| LDHA-1424 Target: | 5'-AUCAACUCCUGAAGUUAGAAAUAag-3'<br>3'-UGUAGUUGAGGACUUCAAUCUUUAUUC-5'<br>5'-ACATCAACTCCTGAAGTTAGAAATAAG-3' | (SEQ ID NO: 2312)<br>(SEQ ID NO: 4326)<br>(SEQ ID NO: 6340) |
| LDHA-1425 Target: | 5'-UCAACUCCUGAAGUUAGAAAUAAga-3'<br>3'-GUAGUUGAGGACUUCAAUCUUUAUUCU-5'<br>5'-CATCAACTCCTGAAGTTAGAAATAAGA-3' | (SEQ ID NO: 2313)<br>(SEQ ID NO: 4327)<br>(SEQ ID NO: 6341) |
| LDHA-1426 Target: | 5'-CAACUCCUGAAGUUAGAAAUAAGaa-3'<br>3'-UAGUUGAGGACUUCAAUCUUUAUUCUU-5'<br>5'-ATCAACTCCTGAAGTTAGAAATAAGAA-3' | (SEQ ID NO: 2314)<br>(SEQ ID NO: 4328)<br>(SEQ ID NO: 6342) |
| LDHA-1429 Target: | 5'-CUCCUGAAGUUAGAAAUAAGAAUgg-3'<br>3'-UUGAGGACUUCAAUCUUUAUUCUUACC-5'<br>5'-AACTCCTGAAGTTAGAAATAAGAATGG-3' | (SEQ ID NO: 2315)<br>(SEQ ID NO: 4329)<br>(SEQ ID NO: 6343) |

TABLE 12-continued

Additional Selected Human Anti-Lactate Dehydrogenase DsiRNA Agents (Asymmetrics)

```
                 5'-UCCUGAAGUUAGAAAUAAGAAUGgt-3'     (SEQ ID NO: 2316)
                 3'-UGAGGACUUCAAUCUUUAUUCUUACCA-5'   (SEQ ID NO: 4330)
LDHA-1430 Target: 5'-ACTCCTGAAGTTAGAAATAAGAATGGT-3'  (SEQ ID NO: 6344)

5'-CCUGAAGUUAGAAAUAAGAAUGGtt-3'     (SEQ ID NO: 2317)
                 3'-GAGGACUUCAAUCUUUAUUCUUACCAA-5'   (SEQ ID NO: 4331)
LDHA-1431 Target: 5'-CTCCTGAAGTTAGAAATAAGAATGGTT-3'  (SEQ ID NO: 6345)

5'-CUGAAGUUAGAAAUAAGAAUGGUtt-3'     (SEQ ID NO: 2318)
                 3'-AGGACUUCAAUCUUUAUUCUUACCAAA-5'   (SEQ ID NO: 4332)
LDHA-1432 Target: 5'-TCCTGAAGTTAGAAATAAGAATGGTTT-3'  (SEQ ID NO: 6346)

5'-UGAAGUUAGAAAUAAGAAUGGUUtg-3'     (SEQ ID NO: 2319)
                 3'-GGACUUCAAUCUUUAUUCUUACCAAAC-5'   (SEQ ID NO: 4333)
LDHA-1433 Target: 5'-CCTGAAGTTAGAAATAAGAATGGTTTG-3'  (SEQ ID NO: 6347)

5'-GAAGUUAGAAAUAAGAAUGGUUUgt-3'     (SEQ ID NO: 2320)
                 3'-GACUUCAAUCUUUAUUCUUACCAAACA-5'   (SEQ ID NO: 4334)
LDHA-1434 Target: 5'-CTGAAGTTAGAAATAAGAATGGTTTGT-3'  (SEQ ID NO: 6348)

5'-AAGUUAGAAAUAAGAAUGGUUUGta-3'     (SEQ ID NO: 2321)
                 3'-ACUUCAAUCUUUAUUCUUACCAAACAU-5'   (SEQ ID NO: 4335)
LDHA-1435 Target: 5'-TGAAGTTAGAAATAAGAATGGTTTGTA-3'  (SEQ ID NO: 6349)

5'-AGUUAGAAAUAAGAAUGGUUUGUaa-3'     (SEQ ID NO: 2322)
                 3'-CUUCAAUCUUUAUUCUUACCAAACAUU-5'   (SEQ ID NO: 4336)
LDHA-1436 Target: 5'-GAAGTTAGAAATAAGAATGGTTTGTAA-3'  (SEQ ID NO: 6350)

5'-GUUAGAAAUAAGAAUGGUUUGUAaa-3'     (SEQ ID NO: 2323)
                 3'-UUCAAUCUUUAUUCUUACCAAACAUUU-5'   (SEQ ID NO: 4337)
LDHA-1437 Target: 5'-AAGTTAGAAATAAGAATGGTTTGTAAA-3'  (SEQ ID NO: 6351)

5'-UUAGAAAUAAGAAUGGUUUGUAAaa-3'     (SEQ ID NO: 2324)
                 3'-UCAAUCUUUAUUCUUACCAAACAUUUU-5'   (SEQ ID NO: 4338)
LDHA-1438 Target: 5'-AGTTAGAAATAAGAATGGTTTGTAAAA-3' (SEQ ID NO: 6352)

5'-UAGAAAUAAGAAUGGUUUGUAAAat-3'     (SEQ ID NO: 2325)
                 3'-CAAUCUUUAUUCUUACCAAACAUUUUA-5'   (SEQ ID NO: 4339)
LDHA-1439 Target: 5'-GTTAGAAATAAGAATGGTTTGTAAAAT-3' (SEQ ID NO: 6353)

5'-AGAAAUAAGAAUGGUUUGUAAAAtc-3'     (SEQ ID NO: 2326)
                 3'-AAUCUUUAUUCUUACCAAACAUUUUAG-5'   (SEQ ID NO: 4340)
LDHA-1440 Target: 5'-TTAGAAATAAGAATGGTTTGTAAAATC-3' (SEQ ID NO: 6354)

5'-GAAAUAAGAAUGGUUUGUAAAAUcc-3'     (SEQ ID NO: 2327)
                 3'-AUCUUUAUUCUUACCAAACAUUUUAGG-5'   (SEQ ID NO: 4341)
LDHA-1441 Target: 5'-TAGAAATAAGAATGGTTTGTAAAATCC-3' (SEQ ID NO: 6355)

5'-AAAUAAGAAUGGUUUGUAAAAUCca-3'     (SEQ ID NO: 2328)
                 3'-UCUUUAUUCUUACCAAACAUUUUAGGU-5'   (SEQ ID NO: 4342)
LDHA-1442 Target: 5'-AGAAATAAGAATGGTTTGTAAAATCCA-3' (SEQ ID NO: 6356)

5'-AAUAAGAAUGGUUUGUAAAAUCCac-3'     (SEQ ID NO: 2329)
                 3'-CUUUAUUCUUACCAAACAUUUUAGGUG-5'   (SEQ ID NO: 4343)
LDHA-1443 Target: 5'-GAAATAAGAATGGTTTGTAAAATCCAC-3' (SEQ ID NO: 6357)

5'-AUAAGAAUGGUUUGUAAAAUCCAca-3'     (SEQ ID NO: 2330)
                 3'-UUUAUUCUUACCAAACAUUUUAGGUGU-5'   (SEQ ID NO: 4344)
LDHA-1444 Target: 5'-AAATAAGAATGGTTTGTAAAATCCACA-3' (SEQ ID NO: 6358)

5'-UAAGAAUGGUUUGUAAAAUCCACag-3'     (SEQ ID NO: 2331)
                 3'-UUAUUCUUACCAAACAUUUUAGGUGUC-5'   (SEQ ID NO: 4345)
LDHA-1445 Target: 5'-AATAAGAATGGTTTGTAAAATCCACAG-3' (SEQ ID NO: 6359)

5'-AAGAAUGGUUUGUAAAAUCCACAgc-3'     (SEQ ID NO: 2332)
                 3'-UAUUCUUACCAAACAUUUUAGGUGUCG-5'   (SEQ ID NO: 4346)
LDHA-1446 Target: 5'-ATAAGAATGGTTTGTAAAATCCACAGC-3' (SEQ ID NO: 6360)

5'-AGAAUGGUUUGUAAAAUCCACAGct-3'     (SEQ ID NO: 2333)
                 3'-AUUCUUACCAAACAUUUUAGGUGUCGA-5'   (SEQ ID NO: 4347)
LDHA-1447 Target: 5'-TAAGAATGGTTTGTAAAATCCACAGCT-3' (SEQ ID NO: 6361)

5'-GAAUGGUUUGUAAAAUCCACAGCta-3'     (SEQ ID NO: 2334)
                 3'-UUCUUACCAAACAUUUUAGGUGUCGAU-5'   (SEQ ID NO: 4348)
LDHA-1448 Target: 5'-AAGAATGGTTTGTAAAATCCACAGCTA-3' (SEQ ID NO: 6362)
```

TABLE 12-continued

Additional Selected Human Anti-Lactate Dehydrogenase DsiRNA Agents (Asymmetrics)

```
                 5'-AAUGGUUUGUAAAAUCCACAGCUat-3'      (SEQ ID NO: 2335)
                 3'-UCUUACCAAACAUUUUAGGUGUCGAUA-5'    (SEQ ID NO: 4349)
LDHA-1449 Target: 5'-AGAATGGTTTGTAAAATCCACAGCTAT-3'   (SEQ ID NO: 6363)

5'-AUGGUUUGUAAAAUCCACAGCUAta-3'      (SEQ ID NO: 2336)
                 3'-CUUUACCAAACAUUUUAGGUGUCGAUAU-5'   (SEQ ID NO: 4350)
LDHA-1450 Target: 5'-GAATGGTTTGTAAAATCCACAGCTATA-3'   (SEQ ID NO: 6364)

5'-UGGUUUGUAAAAUCCACAGCUAUat-3'      (SEQ ID NO: 2337)
                 3'-UUACCAAACAUUUUAGGUGUCGAUAUA-5'    (SEQ ID NO: 4351)
LDHA-1451 Target: 5'-AATGGTTTGTAAAATCCACAGCTATAT-3'   (SEQ ID NO: 6365)

5'-GGUUUGUAAAAUCCACAGCUAUAtc-3'      (SEQ ID NO: 2338)
                 3'-UACCAAACAUUUUAGGUGUCGAUAUAG-5'    (SEQ ID NO: 4352)
LDHA-1452 Target: 5'-ATGGTTTGTAAAATCCACAGCTATATC-3'   (SEQ ID NO: 6366)

5'-GUUUGUAAAAUCCACAGCUAUAUcc-3'      (SEQ ID NO: 2339)
                 3'-ACCAAACAUUUUAGGUGUCGAUAUAGG-5'    (SEQ ID NO: 4353)
LDHA-1453 Target: 5'-TGGTTTGTAAAATCCACAGCTATATCC-3'   (SEQ ID NO: 6367)

5'-UUUGUAAAAUCCACAGCUAUAUCct-3'      (SEQ ID NO: 2340)
                 3'-CCAAACAUUUUAGGUGUCGAUAUAGGA-5'    (SEQ ID NO: 4354)
LDHA-1454 Target: 5'-GGTTTGTAAAATCCACAGCTATATCCT-3'   (SEQ ID NO: 6368)

5'-UUGUAAAAUCCACAGCUAUAUCCtg-3'      (SEQ ID NO: 2341)
                 3'-CAAACAUUUUAGGUGUCGAUAUAGGAC-5'    (SEQ ID NO: 4355)
LDHA-1455 Target: 5'-GTTTGTAAAATCCACAGCTATATCCTG-3'   (SEQ ID NO: 6369)

5'-UGUAAAAUCCACAGCUAUAUCCUga-3'      (SEQ ID NO: 2342)
                 3'-AAACAUUUUAGGUGUCGAUAUAGGACU-5'    (SEQ ID NO: 4356)
LDHA-1456 Target: 5'-TTTGTAAAATCCACAGCTATATCCTGA-3'   (SEQ ID NO: 6370)

5'-GUAAAAUCCACAGCUAUAUCCUGat-3'      (SEQ ID NO: 2343)
                 3'-AACAUUUUAGGUGUCGAUAUAGGACUA-5'    (SEQ ID NO: 4357)
LDHA-1457 Target: 5'-TTGTAAAATCCACAGCTATATCCTGAT-3'   (SEQ ID NO: 6371)

5'-UAAAAUCCACAGCUAUAUCCUGAtg-3'      (SEQ ID NO: 2344)
                 3'-ACAUUUUAGGUGUCGAUAUAGGACUAC-5'    (SEQ ID NO: 4358)
LDHA-1458 Target: 5'-TGTAAAATCCACAGCTATATCCTGATG-3'   (SEQ ID NO: 6372)

5'-AAAAUCCACAGCUAUAUCCUGAUgc-3'      (SEQ ID NO: 2345)
                 3'-CAUUUUAGGUGUCGAUAUAGGACUACG-5'    (SEQ ID NO: 4359)
LDHA-1459 Target: 5'-GTAAAATCCACAGCTATATCCTGATGC-3'   (SEQ ID NO: 6373)

5'-AAAUCCACAGCUAUAUCCUGAUGct-3'      (SEQ ID NO: 2346)
                 3'-AUUUUAGGUGUCGAUAUAGGACUACGA-5'    (SEQ ID NO: 4360)
LDHA-1460 Target: 5'-TAAAATCCACAGCTATATCCTGATGCT-3'   (SEQ ID NO: 6374)

5'-AAUCCACAGCUAUAUCCUGAUGCtg-3'      (SEQ ID NO: 2347)
                 3'-UUUUAGGUGUCGAUAUAGGACUACGAC-5'    (SEQ ID NO: 4361)
LDHA-1461 Target: 5'-AAAATCCACAGCTATATCCTGATGCTG-3'   (SEQ ID NO: 6375)

5'-AUCCACAGCUAUAUCCUGAUGCUgg-3'      (SEQ ID NO: 2348)
                 3'-UUUAGGUGUCGAUAUAGGACUACGACC-5'    (SEQ ID NO: 4362)
LDHA-1462 Target: 5'-AAATCCACAGCTATATCCTGATGCTGG-3'   (SEQ ID NO: 6376)

5'-UCCACAGCUAUAUCCUGAUGCUGga-3'      (SEQ ID NO: 2349)
                 3'-UUAGGUGUCGAUAUAGGACUACGACCU-5'    (SEQ ID NO: 4363)
LDHA-1463 Target: 5'-AATCCACAGCTATATCCTGATGCTGGA-3'   (SEQ ID NO: 6377)

5'-CCACAGCUAUAUCCUGAUGCUGGat-3'      (SEQ ID NO: 2350)
                 3'-UAGGUGUCGAUAUAGGACUACGACCUA-5'    (SEQ ID NO: 4364)
LDHA-1464 Target: 5'-ATCCACAGCTATATCCTGATGCTGGAT-3'   (SEQ ID NO: 6378)

5'-CACAGCUAUAUCCUGAUGCUGGAtg-3'      (SEQ ID NO: 2351)
                 3'-AGGUGUCGAUAUAGGACUACGACCUAC-5'    (SEQ ID NO: 4365)
LDHA-1465 Target: 5'-TCCACAGCTATATCCTGATGCTGGATG-3'   (SEQ ID NO: 6379)

5'-ACAGCUAUAUCCUGAUGCUGGAUgg-3'      (SEQ ID NO: 2352)
                 3'-GGUGUCGAUAUAGGACUACGACCUACC-5'    (SEQ ID NO: 4366)
LDHA-1466 Target: 5'-CCACAGCTATATCCTGATGCTGGATGG-3'   (SEQ ID NO: 6380)

5'-CAGCUAUAUCCUGAUGCUGGAUGgt-3'      (SEQ ID NO: 2353)
                 3'-GUGUCGAUAUAGGACUACGACCUACCA-5'    (SEQ ID NO: 4367)
LDHA-1467 Target: 5'-CACAGCTATATCCTGATGCTGGATGGT-3'   (SEQ ID NO: 6381)
```

TABLE 12-continued

Additional Selected Human Anti-Lactate Dehydrogenase DsiRNA Agents (Asymmetrics)

```
              5'-AGCUAUAUCCUGAUGCUGGAUGGta-3'      (SEQ ID NO: 2354)
              3'-UGUCGAUAUAGGACUACGACCUACCAU-5'    (SEQ ID NO: 4368)
LDHA-1468 Target: 5'-ACAGCTATATCCTGATGCTGGATGGTA-3' (SEQ ID NO: 6382)

5'-GCUAUAUCCUGAUGCUGGAUGGUat-3'      (SEQ ID NO: 2355)
              3'-GUCGAUAUAGGACUACGACCUACCAUA-5'    (SEQ ID NO: 4369)
LDHA-1469 Target: 5'-CAGCTATATCCTGATGCTGGATGGTAT-3' (SEQ ID NO: 6383)

5'-CUAUAUCCUGAUGCUGGAUGGUAtt-3'     (SEQ ID NO: 2356)
              3'-UCGAUAUAGGACUACGACCUACCAUAA-5'   (SEQ ID NO: 4370)
LDHA-1470 Target: 5'-AGCTATATCCTGATGCTGGATGGTATT-3' (SEQ ID NO: 6384)

5'-UAUAUCCUGAUGCUGGAUGGUAUta-3'     (SEQ ID NO: 2357)
              3'-CGAUAUAGGACUACGACCUACCAUAAU-5'   (SEQ ID NO: 4371)
LDHA-1471 Target: 5'-GCTATATCCTGATGCTGGATGGTATTA-3' (SEQ ID NO: 6385)

5'-AUAUCCUGAUGCUGGAUGGUAUUaa-3'     (SEQ ID NO: 2358)
              3'-GAUAUAGGACUACGACCUACCAUAAUU-5'   (SEQ ID NO: 4372)
LDHA-1472 Target: 5'-CTATATCCTGATGCTGGATGGTATTAA-3' (SEQ ID NO: 6386)

5'-UAUCCUGAUGCUGGAUGGUAUUAat-3'     (SEQ ID NO: 2359)
              3'-AUAUAGGACUACGACCUACCAUAAUUA-5'   (SEQ ID NO: 4373)
LDHA-1473 Target: 5'-TATATCCTGATGCTGGATGGTATTAAT-3' (SEQ ID NO: 6387)

5'-AUCCUGAUGCUGGAUGGUAUUAAtc-3'     (SEQ ID NO: 2360)
              3'-UAUAGGACUACGACCUACCAUAAUUAG-5'   (SEQ ID NO: 4374)
LDHA-1474 Target: 5'-ATATCCTGATGCTGGATGGTATTAATC-3' (SEQ ID NO: 6388)

5'-UCCUGAUGCUGGAUGGUAUUAAUct-3'     (SEQ ID NO: 2361)
              3'-AUAGGACUACGACCUACCAUAAUUAGA-5'   (SEQ ID NO: 4375)
LDHA-1475 Target: 5'-TATCCTGATGCTGGATGGTATTAATCT-3' (SEQ ID NO: 6389)

5'-CCUGAUGCUGGAUGGUAUUAAUCtt-3'     (SEQ ID NO: 2362)
              3'-UAGGACUACGACCUACCAUAAUUAGAA-5'   (SEQ ID NO: 4376)
LDHA-1476 Target: 5'-ATCCTGATGCTGGATGGTATTAATCTT-3' (SEQ ID NO: 6390)

5'-CUGAUGCUGGAUGGUAUUAAUCUtg-3'     (SEQ ID NO: 2363)
              3'-AGGACUACGACCUACCAUAAUUAGAAC-5'   (SEQ ID NO: 4377)
LDHA-1477 Target: 5'-TCCTGATGCTGGATGGTATTAATCTTG-3' (SEQ ID NO: 6391)

5'-UGAUGCUGGAUGGUAUUAAUCUUgt-3'     (SEQ ID NO: 2364)
              3'-GGACUACGACCUACCAUAAUUAGAACA-5'   (SEQ ID NO: 4378)
LDHA-1478 Target: 5'-CCTGATGCTGGATGGTATTAATCTTGT-3' (SEQ ID NO: 6392)

5'-GAUGCUGGAUGGUAUUAAUCUUGtg-3'     (SEQ ID NO: 2365)
              3'-GACUACGACCUACCAUAAUUAGAACAC-5'   (SEQ ID NO: 4379)
LDHA-1479 Target: 5'-CTGATGCTGGATGGTATTAATCTTGTG-3' (SEQ ID NO: 6393)

5'-AUGCUGGAUGGUAUUAAUCUUGUgt-3'     (SEQ ID NO: 2366)
              3'-ACUACGACCUACCAUAAUUAGAACACA-5'   (SEQ ID NO: 4380)
LDHA-1480 Target: 5'-TGATGCTGGATGGTATTAATCTTGTGT-3' (SEQ ID NO: 6394)

5'-UGCUGGAUGGUAUUAAUCUUGUGta-3'     (SEQ ID NO: 2367)
              3'-CUACGACCUACCAUAAUUAGAACACAU-5'   (SEQ ID NO: 4381)
LDHA-1481 Target: 5'-GATGCTGGATGGTATTAATCTTGTGTA-3' (SEQ ID NO: 6395)

5'-GCUGGAUGGUAUUAAUCUUGUGUag-3'     (SEQ ID NO: 2368)
              3'-UACGACCUACCAUAAUUAGAACACAUC-5'   (SEQ ID NO: 4382)
LDHA-1482 Target: 5'-ATGCTGGATGGTATTAATCTTGTGTAG-3' (SEQ ID NO: 6396)

5'-CUGGAUGGUAUUAAUCUUGUGUAgt-3'     (SEQ ID NO: 2369)
              3'-ACGACCUACCAUAAUUAGAACACAUCA-5'   (SEQ ID NO: 4383)
LDHA-1483 Target: 5'-TGCTGGATGGTATTAATCTTGTGTAGT-3' (SEQ ID NO: 6397)

5'-UGGAUGGUAUUAAUCUUGUGUAGtc-3'     (SEQ ID NO: 2370)
              3'-CGACCUACCAUAAUUAGAACACAUCAG-5'   (SEQ ID NO: 4384)
LDHA-1484 Target: 5'-GCTGGATGGTATTAATCTTGTGTAGTC-3' (SEQ ID NO: 6398)

5'-GGAUGGUAUUAAUCUUGUGUAGUct-3'     (SEQ ID NO: 2371)
              3'-GACCUACCAUAAUUAGAACACAUCAGA-5'   (SEQ ID NO: 4385)
LDHA-1485 Target: 5'-CTGGATGGTATTAATCTTGTGTAGTCT-3' (SEQ ID NO: 6399)

5'-GAUGGUAUUAAUCUUGUGUAGUCtt-3'     (SEQ ID NO: 2372)
              3'-ACCUACCAUAAUUAGAACACAUCAGAA-5'   (SEQ ID NO: 4386)
LDHA-1486 Target: 5'-TGGATGGTATTAATCTTGTGTAGTCTT-3' (SEQ ID NO: 6400)
```

TABLE 12-continued

Additional Selected Human Anti-Lactate Dehydrogenase DsiRNA Agents (Asymmetrics)

|  |  |  |
|---|---|---|
|  | 5'-AUGGUAUUAAUCUUGUGUAGUCUtc-3' | (SEQ ID NO: 2373) |
|  | 3'-CCUACCAUAAUUAGAACACAUCAGAAG-5' | (SEQ ID NO: 4387) |
| LDHA-1487 Target: | 5'-GGATGGTATTAATCTTGTGTAGTCTTC-3' | (SEQ ID NO: 6401) |
|  | 5'-UGGUAUUAAUCUUGUGUAGUCUUca-3' | (SEQ ID NO: 2374) |
|  | 3'-CUACCAUAAUUAGAACACAUCAGAAGU-5' | (SEQ ID NO: 4388) |
| LDHA-1488 Target: | 5'-GATGGTATTAATCTTGTGTAGTCTTCA-3' | (SEQ ID NO: 6402) |
|  | 5'-GGUAUUAAUCUUGUGUAGUCUUCaa-3' | (SEQ ID NO: 2375) |
|  | 3'-UACCAUAAUUAGAACACAUCAGAAGUU-5' | (SEQ ID NO: 4389) |
| LDHA-1489 Target: | 5'-ATGGTATTAATCTTGTGTAGTCTTCAA-3' | (SEQ ID NO: 6403) |
|  | 5'-GUAUUAAUCUUGUGUAGUCUUCAac-3' | (SEQ ID NO: 2376) |
|  | 3'-ACCAUAAUUAGAACACAUCAGAAGUUG-5' | (SEQ ID NO: 4390) |
| LDHA-1490 Target: | 5'-TGGTATTAATCTTGTGTAGTCTTCAAC-3' | (SEQ ID NO: 6404) |
|  | 5'-UAUUAAUCUUGUGUAGUCUUCAAct-3' | (SEQ ID NO: 2377) |
|  | 3'-CCAUAAUUAGAACACAUCAGAAGUUGA-5' | (SEQ ID NO: 4391) |
| LDHA-1491 Target: | 5'-GGTATTAATCTTGTGTAGTCTTCAACT-3' | (SEQ ID NO: 6405) |
|  | 5'-AUUAAUCUUGUGUAGUCUUCAACtg-3' | (SEQ ID NO: 2378) |
|  | 3'-CAUAAUUAGAACACAUCAGAAGUUGAC-5' | (SEQ ID NO: 4392) |
| LDHA-1492 Target: | 5'-GTATTAATCTTGTGTAGTCTTCAACTG-3' | (SEQ ID NO: 6406) |
|  | 5'-UUAAUCUUGUGUAGUCUUCAACUgg-3' | (SEQ ID NO: 2379) |
|  | 3'-AUAAUUAGAACACAUCAGAAGUUGACC-5' | (SEQ ID NO: 4393) |
| LDHA-1493 Target: | 5'-TATTAATCTTGTGTAGTCTTCAACTGG-3' | (SEQ ID NO: 6407) |
|  | 5'-UAAUCUUGUGUAGUCUUCAACUGgt-3' | (SEQ ID NO: 2380) |
|  | 3'-UAAUUAGAACACAUCAGAAGUUGACCA-5' | (SEQ ID NO: 4394) |
| LDHA-1494 Target: | 5'-ATTAATCTTGTGTAGTCTTCAACTGGT-3' | (SEQ ID NO: 6408) |
|  | 5'-AAUCUUGUGUAGUCUUCAACUGGtt-3' | (SEQ ID NO: 2381) |
|  | 3'-AAUUAGAACACAUCAGAAGUUGACCAA-5' | (SEQ ID NO: 4395) |
| LDHA-1495 Target: | 5'-TTAATCTTGTGTAGTCTTCAACTGGTT-3' | (SEQ ID NO: 6409) |
|  | 5'-AUCUUGUGUAGUCUUCAACUGGUta-3' | (SEQ ID NO: 2382) |
|  | 3'-AUUAGAACACAUCAGAAGUUGACCAAU-5' | (SEQ ID NO: 4396) |
| LDHA-1496 Target: | 5'-TAATCTTGTGTAGTCTTCAACTGGTTA-3' | (SEQ ID NO: 6410) |
|  | 5'-UCUUGUGUAGUCUUCAACUGGUUag-3' | (SEQ ID NO: 2383) |
|  | 3'-UUAGAACACAUCAGAAGUUGACCAAUC-5' | (SEQ ID NO: 4397) |
| LDHA-1497 Target: | 5'-AATCTTGTGTAGTCTTCAACTGGTTAG-3' | (SEQ ID NO: 6411) |
|  | 5'-CUUGUGUAGUCUUCAACUGGUUAgt-3' | (SEQ ID NO: 2384) |
|  | 3'-UAGAACACAUCAGAAGUUGACCAAUCA-5' | (SEQ ID NO: 4398) |
| LDHA-1498 Target: | 5'-ATCTTGTGTAGTCTTCAACTGGTTAGT-3' | (SEQ ID NO: 6412) |
|  | 5'-UUGUGUAGUCUUCAACUGGUUAGtg-3' | (SEQ ID NO: 2385) |
|  | 3'-AGAACACAUCAGAAGUUGACCAAUCAC-5' | (SEQ ID NO: 4399) |
| LDHA-1499 Target: | 5'-TCTTGTGTAGTCTTCAACTGGTTAGTG-3' | (SEQ ID NO: 6413) |
|  | 5'-UGUGUAGUCUUCAACUGGUUAGUgt-3' | (SEQ ID NO: 2386) |
|  | 3'-GAACACAUCAGAAGUUGACCAAUCACA-5' | (SEQ ID NO: 4400) |
| LDHA-1500 Target: | 5'-CTTGTGTAGTCTTCAACTGGTTAGTGT-3' | (SEQ ID NO: 6414) |
|  | 5'-GUGUAGUCUUCAACUGGUUAGUGtg-3' | (SEQ ID NO: 2387) |
|  | 3'-AACACAUCAGAAGUUGACCAAUCACAC-5' | (SEQ ID NO: 4401) |
| LDHA-1501 Target: | 5'-TTGTGTAGTCTTCAACTGGTTAGTGTG-3' | (SEQ ID NO: 6415) |
|  | 5'-UGUAGUCUUCAACUGGUUAGUGUga-3' | (SEQ ID NO: 2388) |
|  | 3'-ACACAUCAGAAGUUGACCAAUCACACU-5' | (SEQ ID NO: 4402) |
| LDHA-1502 Target: | 5'-TGTGTAGTCTTCAACTGGTTAGTGTGA-3' | (SEQ ID NO: 6416) |
|  | 5'-GUAGUCUUCAACUGGUUAGUGUGaa-3' | (SEQ ID NO: 2389) |
|  | 3'-CACAUCAGAAGUUGACCAAUCACACUU-5' | (SEQ ID NO: 4403) |
| LDHA-1503 Target: | 5'-GTGTAGTCTTCAACTGGTTAGTGTGAA-3' | (SEQ ID NO: 6417) |
|  | 5'-UAGUCUUCAACUGGUUAGUGUGAaa-3' | (SEQ ID NO: 2390) |
|  | 3'-ACAUCAGAAGUUGACCAAUCACACUUU-5' | (SEQ ID NO: 4404) |
| LDHA-1504 Target: | 5'-TGTAGTCTTCAACTGGTTAGTGTGAAA-3' | (SEQ ID NO: 6418) |
|  | 5'-AGUCUUCAACUGGUUAGUGUGAAat-3' | (SEQ ID NO: 2391) |
|  | 3'-CAUCAGAAGUUGACCAAUCACACUUUA-5' | (SEQ ID NO: 4405) |
| LDHA-1505 Target: | 5'-GTAGTCTTCAACTGGTTAGTGTGAAAT-3' | (SEQ ID NO: 6419) |

TABLE 12-continued

Additional Selected Human Anti-Lactate Dehydrogenase DsiRNA Agents (Asymmetrics)

| | | |
|---|---|---|
| LDHA-1506 | 5'-GUCUUCAACUGGUUAGUGUGAAAta-3'<br>3'-AUCAGAAGUUGACCAAUCACACUUUAU-5'<br>Target: 5'-TAGTCTTCAACTGGTTAGTGTGAAATA-3' | (SEQ ID NO: 2392)<br>(SEQ ID NO: 4406)<br>(SEQ ID NO: 6420) |
| LDHA-1507 | 5'-UCUUCAACUGGUUAGUGUGAAAUag-3'<br>3'-UCAGAAGUUGACCAAUCACACUUUAUC-5'<br>Target: 5'-AGTCTTCAACTGGTTAGTGTGAAATAG-3' | (SEQ ID NO: 2393)<br>(SEQ ID NO: 4407)<br>(SEQ ID NO: 6421) |
| LDHA-1508 | 5'-CUUCAACUGGUUAGUGUGAAAUAgt-3'<br>3'-CAGAAGUUGACCAAUCACACUUUAUCA-5'<br>Target: 5'-GTCTTCAACTGGTTAGTGTGAAATAGT-3' | (SEQ ID NO: 2394)<br>(SEQ ID NO: 4408)<br>(SEQ ID NO: 6422) |
| LDHA-1509 | 5'-UUCAACUGGUUAGUGUGAAAUAGtt-3'<br>3'-AGAAGUUGACCAAUCACACUUUAUCAA-5'<br>Target: 5'-TCTTCAACTGGTTAGTGTGAAATAGTT-3' | (SEQ ID NO: 2395)<br>(SEQ ID NO: 4409)<br>(SEQ ID NO: 6423) |
| LDHA-1510 | 5'-UCAACUGGUUAGUGUGAAAUAGUtc-3'<br>3'-GAAGUUGACCAAUCACACUUUAUCAAG-5'<br>Target: 5'-CTTCAACTGGTTAGTGTGAAATAGTTC-3' | (SEQ ID NO: 2396)<br>(SEQ ID NO: 4410)<br>(SEQ ID NO: 6424) |
| LDHA-1511 | 5'-CAACUGGUUAGUGUGAAAUAGUUct-3'<br>3'-AAGUUGACCAAUCACACUUUAUCAAGA-5'<br>Target: 5'-TTCAACTGGTTAGTGTGAAATAGTTCT-3' | (SEQ ID NO: 2397)<br>(SEQ ID NO: 4411)<br>(SEQ ID NO: 6425) |
| LDHA-1515 | 5'-UGGUUAGUGUGAAAUAGUUCUGCca-3'<br>3'-UGACCAAUCACACUUUAUCAAGACGGU-5'<br>Target: 5'-ACTGGTTAGTGTGAAATAGTTCTGCCA-3' | (SEQ ID NO: 2398)<br>(SEQ ID NO: 4412)<br>(SEQ ID NO: 6426) |
| LDHA-1517 | 5'-GUUAGUGUGAAAUAGUUCUGCCAcc-3'<br>3'-ACCAAUCACACUUUAUCAAGACGGUGG-5'<br>Target: 5'-TGGTTAGTGTGAAATAGTTCTGCCACC-3' | (SEQ ID NO: 2399)<br>(SEQ ID NO: 4413)<br>(SEQ ID NO: 6427) |
| LDHA-1518 | 5'-UUAGUGUGAAAUAGUUCUGCCACct-3'<br>3'-CCAAUCACACUUUAUCAAGACGGUGGA-5'<br>Target: 5'-GGTTAGTGTGAAATAGTTCTGCCACCT-3' | (SEQ ID NO: 2400)<br>(SEQ ID NO: 4414)<br>(SEQ ID NO: 6428) |
| LDHA-1519 | 5'-UAGUGUGAAAUAGUUCUGCCACCtc-3'<br>3'-CAAUCACACUUUAUCAAGACGGUGGAG-5'<br>Target: 5'-GTTAGTGTGAAATAGTTCTGCCACCTC-3' | (SEQ ID NO: 2401)<br>(SEQ ID NO: 4415)<br>(SEQ ID NO: 6429) |
| LDHA-1520 | 5'-AGUGUGAAAUAGUUCUGCCACCUct-3'<br>3'-AAUCACACUUUAUCAAGACGGUGGAGA-5'<br>Target: 5'-TTAGTGTGAAATAGTTCTGCCACCTCT-3' | (SEQ ID NO: 2402)<br>(SEQ ID NO: 4416)<br>(SEQ ID NO: 6430) |
| LDHA-1521 | 5'-GUGUGAAAUAGUUCUGCCACCUCtg-3'<br>3'-AUCACACUUUAUCAAGACGGUGGAGAC-5'<br>Target: 5'-TAGTGTGAAATAGTTCTGCCACCTCTG-3' | (SEQ ID NO: 2403)<br>(SEQ ID NO: 4417)<br>(SEQ ID NO: 6431) |
| LDHA-1522 | 5'-UGUGAAAUAGUUCUGCCACCUCUga-3'<br>3'-UCACACUUUAUCAAGACGGUGGAGACU-5'<br>Target: 5'-AGTGTGAAATAGTTCTGCCACCTCTGA-3' | (SEQ ID NO: 2404)<br>(SEQ ID NO: 4418)<br>(SEQ ID NO: 6432) |
| LDHA-1523 | 5'-GUGAAAUAGUUCUGCCACCUCUGac-3'<br>3'-CACACUUUAUCAAGACGGUGGAGACUG-5'<br>Target: 5'-GTGTGAAATAGTTCTGCCACCTCTGAC-3' | (SEQ ID NO: 2405)<br>(SEQ ID NO: 4419)<br>(SEQ ID NO: 6433) |
| LDHA-1524 | 5'-UGAAAUAGUUCUGCCACCUCUGAcg-3'<br>3'-ACACUUUAUCAAGACGGUGGAGACUGC-5'<br>Target: 5'-TGTGAAATAGTTCTGCCACCTCTGACG-3' | (SEQ ID NO: 2406)<br>(SEQ ID NO: 4420)<br>(SEQ ID NO: 6434) |
| LDHA-1525 | 5'-GAAAUAGUUCUGCCACCUCUGACgc-3'<br>3'-CACUUUAUCAAGACGGUGGAGACUGCG-5'<br>Target: 5'-GTGAAATAGTTCTGCCACCTCTGACGC-3' | (SEQ ID NO: 2407)<br>(SEQ ID NO: 4421)<br>(SEQ ID NO: 6435) |
| LDHA-1526 | 5'-AAAUAGUUCUGCCACCUCUGACGca-3'<br>3'-ACUUUAUCAAGACGGUGGAGACUGCGU-5'<br>Target: 5'-TGAAATAGTTCTGCCACCTCTGACGCA-3' | (SEQ ID NO: 2408)<br>(SEQ ID NO: 4422)<br>(SEQ ID NO: 6436) |
| LDHA-1527 | 5'-AAUAGUUCUGCCACCUCUGACGCac-3'<br>3'-CUUUAUCAAGACGGUGGAGACUGCGUG-5'<br>Target: 5'-GAAATAGTTCTGCCACCTCTGACGCAC-3' | (SEQ ID NO: 2409)<br>(SEQ ID NO: 4423)<br>(SEQ ID NO: 6437) |
| LDHA-1528 | 5'-AUAGUUCUGCCACCUCUGACGCAcc-3'<br>3'-UUUAUCAAGACGGUGGAGACUGCGUGG-5'<br>Target: 5'-AAATAGTTCTGCCACCTCTGACGCACC-3' | (SEQ ID NO: 2410)<br>(SEQ ID NO: 4424)<br>(SEQ ID NO: 6438) |

TABLE 12-continued

Additional Selected Human Anti-Lactate Dehydrogenase DsiRNA Agents (Asymmetrics)

|  |  |  |
|---|---|---|
| LDHA-1529 Target: | 5'-UAGUUCUGCCACCUCUGACGCACca-3'<br>3'-UUAUCAAGACGGUGGAGACUGCGUGGU-5'<br>5'-AATAGTTCTGCCACCTCTGACGCACCA-3' | (SEQ ID NO: 2411)<br>(SEQ ID NO: 4425)<br>(SEQ ID NO: 6439) |
| LDHA-1530 Target: | 5'-AGUUCUGCCACCUCUGACGCACCac-3'<br>3'-UAUCAAGACGGUGGAGACUGCGUGGUG-5'<br>5'-ATAGTTCTGCCACCTCTGACGCACCAC-3' | (SEQ ID NO: 2412)<br>(SEQ ID NO: 4426)<br>(SEQ ID NO: 6440) |
| LDHA-1531 Target: | 5'-GUUCUGCCACCUCUGACGCACCAct-3'<br>3'-AUCAAGACGGUGGAGACUGCGUGGUGA-5'<br>5'-TAGTTCTGCCACCTCTGACGCACCACT-3' | (SEQ ID NO: 2413)<br>(SEQ ID NO: 4427)<br>(SEQ ID NO: 6441) |
| LDHA-1532 Target: | 5'-UUCUGCCACCUCUGACGCACCACtg-3'<br>3'-UCAAGACGGUGGAGACUGCGUGGUGAC-5'<br>5'-AGTTCTGCCACCTCTGACGCACCACTG-3' | (SEQ ID NO: 2414)<br>(SEQ ID NO: 4428)<br>(SEQ ID NO: 6442) |
| LDHA-1533 Target: | 5'-UCUGCCACCUCUGACGCACCACUgc-3'<br>3'-CAAGACGGUGGAGACUGCGUGGUGACG-5'<br>5'-GTTCTGCCACCTCTGACGCACCACTGC-3' | (SEQ ID NO: 2415)<br>(SEQ ID NO: 4429)<br>(SEQ ID NO: 6443) |
| LDHA-1534 Target: | 5'-CUGCCACCUCUGACGCACCACUGcc-3'<br>3'-AAGACGGUGGAGACUGCGUGGUGACGG-5'<br>5'-TTCTGCCACCTCTGACGCACCACTGCC-3' | (SEQ ID NO: 2416)<br>(SEQ ID NO: 4430)<br>(SEQ ID NO: 6444) |
| LDHA-1535 Target: | 5'-UGCCACCUCUGACGCACCACUGCca-3'<br>3'-AGACGGUGGAGACUGCGUGGUGACGGU-5'<br>5'-TCTGCCACCTCTGACGCACCACTGCCA-3' | (SEQ ID NO: 2417)<br>(SEQ ID NO: 4431)<br>(SEQ ID NO: 6445) |
| LDHA-1536 Target: | 5'-GCCACCUCUGACGCACCACUGCCaa-3'<br>3'-GACGGUGGAGACUGCGUGGUGACGGUU-5'<br>5'-CTGCCACCTCTGACGCACCACTGCCAA-3' | (SEQ ID NO: 2418)<br>(SEQ ID NO: 4432)<br>(SEQ ID NO: 6446) |
| LDHA-1537 Target: | 5'-CCACCUCUGACGCACCACUGCCAat-3'<br>3'-ACGGUGGAGACUGCGUGGUGACGGUUA-5'<br>5'-TGCCACCTCTGACGCACCACTGCCAAT-3' | (SEQ ID NO: 2419)<br>(SEQ ID NO: 4433)<br>(SEQ ID NO: 6447) |
| LDHA-1538 Target: | 5'-CACCUCUGACGCACCACUGCCAAtg-3'<br>3'-CGGUGGAGACUGCGUGGUGACGGUUAC-5'<br>5'-GCCACCTCTGACGCACCACTGCCAATG-3' | (SEQ ID NO: 2420)<br>(SEQ ID NO: 4434)<br>(SEQ ID NO: 6448) |
| LDHA-1539 Target: | 5'-ACCUCUGACGCACCACUGCCAAUgc-3'<br>3'-GGUGGAGACUGCGUGGUGACGGUUACG-5'<br>5'-CCACCTCTGACGCACCACTGCCAATGC-3' | (SEQ ID NO: 2421)<br>(SEQ ID NO: 4435)<br>(SEQ ID NO: 6449) |
| LDHA-1540 Target: | 5'-CCUCUGACGCACCACUGCCAAUGct-3'<br>3'-GUGGAGACUGCGUGGUGACGGUUACGA-5'<br>5'-CACCTCTGACGCACCACTGCCAATGCT-3' | (SEQ ID NO: 2422)<br>(SEQ ID NO: 4436)<br>(SEQ ID NO: 6450) |
| LDHA-1541 Target: | 5'-CUCUGACGCACCACUGCCAAUGCtg-3'<br>3'-UGGAGACUGCGUGGUGACGGUUACGAC-5'<br>5'-ACCTCTGACGCACCACTGCCAATGCTG-3' | (SEQ ID NO: 2423)<br>(SEQ ID NO: 4437)<br>(SEQ ID NO: 6451) |
| LDHA-1542 Target: | 5'-UCUGACGCACCACUGCCAAUGCUgt-3'<br>3'-GGAGACUGCGUGGUGACGGUUACGACA-5'<br>5'-CCTCTGACGCACCACTGCCAATGCTGT-3' | (SEQ ID NO: 2424)<br>(SEQ ID NO: 4438)<br>(SEQ ID NO: 6452) |
| LDHA-1543 Target: | 5'-CUGACGCACCACUGCCAAUGCUGta-3'<br>3'-GAGACUGCGUGGUGACGGUUACGACAU-5'<br>5'-CTCTGACGCACCACTGCCAATGCTGTA-3' | (SEQ ID NO: 2425)<br>(SEQ ID NO: 4439)<br>(SEQ ID NO: 6453) |
| LDHA-1544 Target: | 5'-UGACGCACCACUGCCAAUGCUGUac-3'<br>3'-AGACUGCGUGGUGACGGUUACGACAUG-5'<br>5'-TCTGACGCACCACTGCCAATGCTGTAC-3' | (SEQ ID NO: 2426)<br>(SEQ ID NO: 4440)<br>(SEQ ID NO: 6454) |
| LDHA-1545 Target: | 5'-GACGCACCACUGCCAAUGCUGUAcg-3'<br>3'-GACUGCGUGGUGACGGUUACGACAUGC-5'<br>5'-CTGACGCACCACTGCCAATGCTGTACG-3' | (SEQ ID NO: 2427)<br>(SEQ ID NO: 4441)<br>(SEQ ID NO: 6455) |
| LDHA-1546 Target: | 5'-ACGCACCACUGCCAAUGCUGUACgt-3'<br>3'-ACUGCGUGGUGACGGUUACGACAUGCA-5'<br>5'-TGACGCACCACTGCCAATGCTGTACGT-3' | (SEQ ID NO: 2428)<br>(SEQ ID NO: 4442)<br>(SEQ ID NO: 6456) |
| LDHA-1547 Target: | 5'-CGCACCACUGCCAAUGCUGUACGta-3'<br>3'-CUGCGUGGUGACGGUUACGACAUGCAU-5'<br>5'-GACGCACCACTGCCAATGCTGTACGTA-3' | (SEQ ID NO: 2429)<br>(SEQ ID NO: 4443)<br>(SEQ ID NO: 6457) |

TABLE 12-continued

Additional Selected Human Anti-Lactate Dehydrogenase DsiRNA Agents (Asymmetrics)

|  |  |  |
| --- | --- | --- |
| LDHA-1548 Target: | 5'-GCACCACUGCCAAUGCUGUACGUac-3'<br>3'-UGCGUGGUGACGGUUACGACAUGCAUG-5'<br>5'-ACGCACCACTGCCAATGCTGTACGTAC-3' | (SEQ ID NO: 2430)<br>(SEQ ID NO: 4444)<br>(SEQ ID NO: 6458) |
| LDHA-1549 Target: | 5'-CACCACUGCCAAUGCUGUACGUAct-3'<br>3'-GCGUGGUGACGGUUACGACAUGCAUGA-5'<br>5'-CGCACCACTGCCAATGCTGTACGTACT-3' | (SEQ ID NO: 2431)<br>(SEQ ID NO: 4445)<br>(SEQ ID NO: 6459) |
| LDHA-1550 Target: | 5'-ACCACUGCCAAUGCUGUACGUACtg-3'<br>3'-CGUGGUGACGGUUACGACAUGCAUGAC-5'<br>5'-GCACCACTGCCAATGCTGTACGTACTG-3' | (SEQ ID NO: 2432)<br>(SEQ ID NO: 4446)<br>(SEQ ID NO: 6460) |
| LDHA-1551 Target: | 5'-CCACUGCCAAUGCUGUACGUACUgc-3'<br>3'-GUGGUGACGGUUACGACAUGCAUGACG-5'<br>5'-CACCACTGCCAATGCTGTACGTACTGC-3' | (SEQ ID NO: 2433)<br>(SEQ ID NO: 4447)<br>(SEQ ID NO: 6461) |
| LDHA-1552 Target: | 5'-CACUGCCAAUGCUGUACGUACUGca-3'<br>3'-UGGUGACGGUUACGACAUGCAUGACGU-5'<br>5'-ACCACTGCCAATGCTGTACGTACTGCA-3' | (SEQ ID NO: 2434)<br>(SEQ ID NO: 4448)<br>(SEQ ID NO: 6462) |
| LDHA-1553 Target: | 5'-ACUGCCAAUGCUGUACGUACUGCat-3'<br>3'-GGUGACGGUUACGACAUGCAUGACGUA-5'<br>5'-CCACTGCCAATGCTGTACGTACTGCAT-3' | (SEQ ID NO: 2435)<br>(SEQ ID NO: 4449)<br>(SEQ ID NO: 6463) |
| LDHA-1554 Target: | 5'-CUGCCAAUGCUGUACGUACUGCAtt-3'<br>3'-GUGACGGUUACGACAUGCAUGACGUAA-5'<br>5'-CACTGCCAATGCTGTACGTACTGCATT-3' | (SEQ ID NO: 2436)<br>(SEQ ID NO: 4450)<br>(SEQ ID NO: 6464) |
| LDHA-1555 Target: | 5'-UGCCAAUGCUGUACGUACUGCAUtt-3'<br>3'-UGACGGUUACGACAUGCAUGACGUAAA-5'<br>5'-ACTGCCAATGCTGTACGTACTGCATTT-3' | (SEQ ID NO: 2437)<br>(SEQ ID NO: 4451)<br>(SEQ ID NO: 6465) |
| LDHA-1556 Target: | 5'-GCCAAUGCUGUACGUACUGCAUUtg-3'<br>3'-GACGGUUACGACAUGCAUGACGUAAAC-5'<br>5'-CTGCCAATGCTGTACGTACTGCATTTG-3' | (SEQ ID NO: 2438)<br>(SEQ ID NO: 4452)<br>(SEQ ID NO: 6466) |
| LDHA-1557 Target: | 5'-CCAAUGCUGUACGUACUGCAUUUgc-3'<br>3'-ACGGUUACGACAUGCAUGACGUAAACG-5'<br>5'-TGCCAATGCTGTACGTACTGCATTTGC-3' | (SEQ ID NO: 2439)<br>(SEQ ID NO: 4453)<br>(SEQ ID NO: 6467) |
| LDHA-1558 Target: | 5'-CAAUGCUGUACGUACUGCAUUUGcc-3'<br>3'-CGGUUACGACAUGCAUGACGUAAACGG-5'<br>5'-GCCAATGCTGTACGTACTGCATTTGCC-3' | (SEQ ID NO: 2440)<br>(SEQ ID NO: 4454)<br>(SEQ ID NO: 6468) |
| LDHA-1559 Target: | 5'-AAUGCUGUACGUACUGCAUUUGCcc-3'<br>3'-GGUUACGACAUGCAUGACGUAAACGGG-5'<br>5'-CCAATGCTGTACGTACTGCATTTGCCC-3' | (SEQ ID NO: 2441)<br>(SEQ ID NO: 4455)<br>(SEQ ID NO: 6469) |
| LDHA-1560 Target: | 5'-AUGCUGUACGUACUGCAUUUGCCcc-3'<br>3'-GUUACGACAUGCAUGACGUAAACGGGG-5'<br>5'-CAATGCTGTACGTACTGCATTTGCCCC-3' | (SEQ ID NO: 2442)<br>(SEQ ID NO: 4456)<br>(SEQ ID NO: 6470) |
| LDHA-1561 Target: | 5'-UGCUGUACGUACUGCAUUUGCCCct-3'<br>3'-UUACGACAUGCAUGACGUAAACGGGGA-5'<br>5'-AATGCTGTACGTACTGCATTTGCCCCT-3' | (SEQ ID NO: 2443)<br>(SEQ ID NO: 4457)<br>(SEQ ID NO: 6471) |
| LDHA-1562 Target: | 5'-GCUGUACGUACUGCAUUUGCCCCtt-3'<br>3'-UACGACAUGCAUGACGUAAACGGGGAA-5'<br>5'-ATGCTGTACGTACTGCATTTGCCCCTT-3' | (SEQ ID NO: 2444)<br>(SEQ ID NO: 4458)<br>(SEQ ID NO: 6472) |
| LDHA-1563 Target: | 5'-CUGUACGUACUGCAUUUGCCCCUtg-3'<br>3'-ACGACAUGCAUGACGUAAACGGGGAAC-5'<br>5'-TGCTGTACGTACTGCATTTGCCCCTTG-3' | (SEQ ID NO: 2445)<br>(SEQ ID NO: 4459)<br>(SEQ ID NO: 6473) |
| LDHA-1564 Target: | 5'-UGUACGUACUGCAUUUGCCCCUUga-3'<br>3'-CGACAUGCAUGACGUAAACGGGGAACU-5'<br>5'-GCTGTACGTACTGCATTTGCCCCTTGA-3' | (SEQ ID NO: 2446)<br>(SEQ ID NO: 4460)<br>(SEQ ID NO: 6474) |
| LDHA-1565 Target: | 5'-GUACGUACUGCAUUUGCCCCUUGag-3'<br>3'-GACAUGCAUGACGUAAACGGGGAACUC-5'<br>5'-CTGTACGTACTGCATTTGCCCCTTGAG-3' | (SEQ ID NO: 2447)<br>(SEQ ID NO: 4461)<br>(SEQ ID NO: 6475) |
| LDHA-1566 Target: | 5'-UACGUACUGCAUUUGCCCCUUGAgc-3'<br>3'-ACAUGCAUGACGUAAACGGGGAACUCG-5'<br>5'-TGTACGTACTGCATTTGCCCCTTGAGC-3' | (SEQ ID NO: 2448)<br>(SEQ ID NO: 4462)<br>(SEQ ID NO: 6476) |

TABLE 12-continued

Additional Selected Human Anti-Lactate Dehydrogenase DsiRNA Agents (Asymmetrics)

|               |         |                                                  |                    |
|---------------|---------|--------------------------------------------------|--------------------|
| LDHA-1567     |         | 5'-ACGUACUGCAUUUGCCCCUUGAGCcc-3'                 | (SEQ ID NO: 2449)  |
|               |         | 3'-CAUGCAUGACGUAAACGGGGAACUCGG-5'                | (SEQ ID NO: 4463)  |
|               | Target: | 5'-GTACGTACTGCATTTGCCCCTTGAGCC-3'                | (SEQ ID NO: 6477)  |
| LDHA-1568     |         | 5'-CGUACUGCAUUUGCCCCUUGAGCca-3'                  | (SEQ ID NO: 2450)  |
|               |         | 3'-AUGCAUGACGUAAACGGGGAACUCGGU-5'                | (SEQ ID NO: 4464)  |
|               | Target: | 5'-TACGTACTGCATTTGCCCCTTGAGCCA-3'                | (SEQ ID NO: 6478)  |
| LDHA-1569     |         | 5'-GUACUGCAUUUGCCCCUUGAGCCag-3'                  | (SEQ ID NO: 2451)  |
|               |         | 3'-UGCAUGACGUAAACGGGGAACUCGGUC-5'                | (SEQ ID NO: 4465)  |
|               | Target: | 5'-ACGTACTGCATTTGCCCCTTGAGCCAG-3'                | (SEQ ID NO: 6479)  |
| LDHA-1570     |         | 5'-UACUGCAUUUGCCCCUUGAGCCAgg-3'                  | (SEQ ID NO: 2452)  |
|               |         | 3'-GCAUGACGUAAACGGGGAACUCGGUCC-5'                | (SEQ ID NO: 4466)  |
|               | Target: | 5'-CGTACTGCATTTGCCCCTTGAGCCAGG-3'                | (SEQ ID NO: 6480)  |
| LDHA-1571     |         | 5'-ACUGCAUUUGCCCCUUGAGCCAGgt-3'                  | (SEQ ID NO: 2453)  |
|               |         | 3'-CAUGACGUAAACGGGGAACUCGGUCCA-5'                | (SEQ ID NO: 4467)  |
|               | Target: | 5'-GTACTGCATTTGCCCCTTGAGCCAGGT-3'                | (SEQ ID NO: 6481)  |
| LDHA-1572     |         | 5'-CUGCAUUUGCCCCUUGAGCCAGGtg-3'                  | (SEQ ID NO: 2454)  |
|               |         | 3'-AUGACGUAAACGGGGAACUCGGUCCAC-5'                | (SEQ ID NO: 4468)  |
|               | Target: | 5'-TACTGCATTTGCCCCTTGAGCCAGGTG-3'                | (SEQ ID NO: 6482)  |
| LDHA-1573     |         | 5'-UGCAUUUGCCCCUUGAGCCAGGUgg-3'                  | (SEQ ID NO: 2455)  |
|               |         | 3'-UGACGUAAACGGGGAACUCGGUCCACC-5'                | (SEQ ID NO: 4469)  |
|               | Target: | 5'-ACTGCATTTGCCCCTTGAGCCAGGTGG-3'                | (SEQ ID NO: 6483)  |
| LDHA-1574     |         | 5'-GCAUUUGCCCCUUGAGCCAGGUGga-3'                  | (SEQ ID NO: 2456)  |
|               |         | 3'-GACGUAAACGGGGAACUCGGUCCACCU-5'                | (SEQ ID NO: 4470)  |
|               | Target: | 5'-CTGCATTTGCCCCTTGAGCCAGGTGGA-3'                | (SEQ ID NO: 6484)  |
| LDHA-1575     |         | 5'-CAUUUGCCCCUUGAGCCAGGUGGat-3'                  | (SEQ ID NO: 2457)  |
|               |         | 3'-ACGUAAACGGGGAACUCGGUCCACCUA-5'                | (SEQ ID NO: 4471)  |
|               | Target: | 5'-TGCATTTGCCCCTTGAGCCAGGTGGAT-3'                | (SEQ ID NO: 6485)  |
| LDHA-1576     |         | 5'-AUUUGCCCCUUGAGCCAGGUGGAtg-3'                  | (SEQ ID NO: 2458)  |
|               |         | 3'-CGUAAACGGGGAACUCGGUCCACCUAC-5'                | (SEQ ID NO: 4472)  |
|               | Target: | 5'-GCATTTGCCCCTTGAGCCAGGTGGATG-3'                | (SEQ ID NO: 6486)  |
| LDHA-1577     |         | 5'-UUUGCCCCUUGAGCCAGGUGGAUgt-3'                  | (SEQ ID NO: 2459)  |
|               |         | 3'-GUAAACGGGGAACUCGGUCCACCUACA-5'                | (SEQ ID NO: 4473)  |
|               | Target: | 5'-CATTTGCCCCTTGAGCCAGGTGGATGT-3'                | (SEQ ID NO: 6487)  |
| LDHA-1578     |         | 5'-UUGCCCCUUGAGCCAGGUGGAUGtt-3'                  | (SEQ ID NO: 2460)  |
|               |         | 3'-UAAACGGGGAACUCGGUCCACCUACAA-5'                | (SEQ ID NO: 4474)  |
|               | Target: | 5'-ATTTGCCCCTTGAGCCAGGTGGATGTT-3'                | (SEQ ID NO: 6488)  |
| LDHA-1579     |         | 5'-UGCCCCUUGAGCCAGGUGGAUGUtt-3'                  | (SEQ ID NO: 2461)  |
|               |         | 3'-AAACGGGGAACUCGGUCCACCUACAAA-5'                | (SEQ ID NO: 4475)  |
|               | Target: | 5'-TTTGCCCCTTGAGCCAGGTGGATGTTT-3'                | (SEQ ID NO: 6489)  |
| LDHA-1580     |         | 5'-GCCCCUUGAGCCAGGUGGAUGUUta-3'                  | (SEQ ID NO: 2462)  |
|               |         | 3'-AACGGGGAACUCGGUCCACCUACAAAU-5'                | (SEQ ID NO: 4476)  |
|               | Target: | 5'-TTGCCCCTTGAGCCAGGTGGATGTTTA-3'                | (SEQ ID NO: 6490)  |
| LDHA-1581     |         | 5'-CCCCUUGAGCCAGGUGGAUGUUUac-3'                  | (SEQ ID NO: 2463)  |
|               |         | 3'-ACGGGGAACUCGGUCCACCUACAAAUG-5'                | (SEQ ID NO: 4477)  |
|               | Target: | 5'-TGCCCCTTGAGCCAGGTGGATGTTTAC-3'                | (SEQ ID NO: 6491)  |
| LDHA-1582     |         | 5'-CCCUUGAGCCAGGUGGAUGUUUAcc-3'                  | (SEQ ID NO: 2464)  |
|               |         | 3'-CGGGGAACUCGGUCCACCUACAAAUGG-5'                | (SEQ ID NO: 4478)  |
|               | Target: | 5'-GCCCCTTGAGCCAGGTGGATGTTTACC-3'                | (SEQ ID NO: 6492)  |
| LDHA-1583     |         | 5'-CCUUGAGCCAGGUGGAUGUUUACcg-3'                  | (SEQ ID NO: 2465)  |
|               |         | 3'-GGGGAACUCGGUCCACCUACAAAUGGC-5'                | (SEQ ID NO: 4479)  |
|               | Target: | 5'-CCCCTTGAGCCAGGTGGATGTTTACCG-3'                | (SEQ ID NO: 6493)  |
| LDHA-1584     |         | 5'-CUUGAGCCAGGUGGAUGUUUACCgt-3'                  | (SEQ ID NO: 2466)  |
|               |         | 3'-GGGAACUCGGUCCACCUACAAAUGGCA-5'                | (SEQ ID NO: 4480)  |
|               | Target: | 5'-CCCTTGAGCCAGGTGGATGTTTACCGT-3'                | (SEQ ID NO: 6494)  |
| LDHA-1585     |         | 5'-UUGAGCCAGGUGGAUGUUUACCGtg-3'                  | (SEQ ID NO: 2467)  |
|               |         | 3'-GGAACUCGGUCCACCUACAAAUGGCAC-5'                | (SEQ ID NO: 4481)  |
|               | Target: | 5'-CCTTGAGCCAGGTGGATGTTTACCGTG-3'                | (SEQ ID NO: 6495)  |

TABLE 12-continued

Additional Selected Human Anti-Lactate Dehydrogenase DsiRNA Agents (Asymmetrics)

```
                   5'-UGAGCCAGGUGGAUGUUUACCGUgt-3'        (SEQ ID NO: 2468)
                   3'-GAACUCGGUCCACCUACAAAUGGCACA-5'      (SEQ ID NO: 4482)
LDHA-1586 Target:  5'-CTTGAGCCAGGTGGATGTTTACCGTGT-3'      (SEQ ID NO: 6496)

5'-GAGCCAGGUGGAUGUUUACCGUGtg-3'        (SEQ ID NO: 2469)
                   3'-AACUCGGUCCACCUACAAAUGGCACAC-5'      (SEQ ID NO: 4483)
LDHA-1587 Target:  5'-TTGAGCCAGGTGGATGTTTACCGTGTG-3'     (SEQ ID NO: 6497)

5'-AGCCAGGUGGAUGUUUACCGUGUgt-3'        (SEQ ID NO: 2470)
                   3'-ACUCGGUCCACCUACAAAUGGCACACA-5'      (SEQ ID NO: 4484)
LDHA-1588 Target:  5'-TGAGCCAGGTGGATGTTTACCGTGTGT-3'     (SEQ ID NO: 6498)

5'-GCCAGGUGGAUGUUUACCGUGUGtt-3'        (SEQ ID NO: 2471)
                   3'-CUCGGUCCACCUACAAAUGGCACACAA-5'      (SEQ ID NO: 4485)
LDHA-1589 Target:  5'-GAGCCAGGTGGATGTTTACCGTGTGTT-3'     (SEQ ID NO: 6499)

5'-CCAGGUGGAUGUUUACCGUGUGUta-3'        (SEQ ID NO: 2472)
                   3'-UCGGUCCACCUACAAAUGGCACACAAU-5'      (SEQ ID NO: 4486)
LDHA-1590 Target:  5'-AGCCAGGTGGATGTTTACCGTGTGTTA-3'     (SEQ ID NO: 6500)

5'-CAGGUGGAUGUUUACCGUGUGUUat-3'        (SEQ ID NO: 2473)
                   3'-CGGUCCACCUACAAAUGGCACACAAUA-5'      (SEQ ID NO: 4487)
LDHA-1591 Target:  5'-GCCAGGTGGATGTTTACCGTGTGTTAT-3'     (SEQ ID NO: 6501)

5'-AGGUGGAUGUUUACCGUGUGUUAta-3'        (SEQ ID NO: 2474)
                   3'-GGUCCACCUACAAAUGGCACACAAUAU-5'      (SEQ ID NO: 4488)
LDHA-1592 Target:  5'-CCAGGTGGATGTTTACCGTGTGTTATA-3'     (SEQ ID NO: 6502)

5'-GGUGGAUGUUUACCGUGUGUUAUat-3'        (SEQ ID NO: 2475)
                   3'-GUCCACCUACAAAUGGCACACAAUAUA-5'      (SEQ ID NO: 4489)
LDHA-1593 Target:  5'-CAGGTGGATGTTTACCGTGTGTTATAT-3'     (SEQ ID NO: 6503)

5'-GUGGAUGUUUACCGUGUGUUAUAta-3'        (SEQ ID NO: 2476)
                   3'-UCCACCUACAAAUGGCACACAAUAUAU-5'      (SEQ ID NO: 4490)
LDHA-1594 Target:  5'-AGGTGGATGTTTACCGTGTGTTATATA-3'     (SEQ ID NO: 6504)

5'-UGGAUGUUUACCGUGUGUUAUAUaa-3'        (SEQ ID NO: 2477)
                   3'-CCACCUACAAAUGGCACACAAUAUAUU-5'      (SEQ ID NO: 4491)
LDHA-1595 Target:  5'-GGTGGATGTTTACCGTGTGTTATATAA-3'     (SEQ ID NO: 6505)

5'-GGAUGUUUACCGUGUGUUAUAUAac-3'        (SEQ ID NO: 2478)
                   3'-CACCUACAAAUGGCACACAAUAUAUUG-5'      (SEQ ID NO: 4492)
LDHA-1596 Target:  5'-GTGGATGTTTACCGTGTGTTATATAAC-3'     (SEQ ID NO: 6506)

5'-GAUGUUUACCGUGUGUUAUAUAAct-3'        (SEQ ID NO: 2479)
                   3'-ACCUACAAAUGGCACACAAUAUAUUGA-5'      (SEQ ID NO: 4493)
LDHA-1597 Target:  5'-TGGATGTTTACCGTGTGTTATATAACT-3'     (SEQ ID NO: 6507)

5'-AUGUUUACCGUGUGUUAUAUAACtt-3'        (SEQ ID NO: 2480)
                   3'-CCUACAAAUGGCACACAAUAUAUUGAA-5'      (SEQ ID NO: 4494)
LDHA-1598 Target:  5'-GGATGTTTACCGTGTGTTATATAACTT-3'     (SEQ ID NO: 6508)

5'-UGUUUACCGUGUGUUAUAUAACUtc-3'        (SEQ ID NO: 2481)
                   3'-CUACAAAUGGCACACAAUAUAUUGAAG-5'      (SEQ ID NO: 4495)
LDHA-1599 Target:  5'-GATGTTTACCGTGTGTTATATAACTTC-3'     (SEQ ID NO: 6509)

5'-GUUUACCGUGUGUUAUAUAACUUcc-3'        (SEQ ID NO: 2482)
                   3'-UACAAAUGGCACACAAUAUAUUGAAGG-5'      (SEQ ID NO: 4496)
LDHA-1600 Target:  5'-ATGTTTACCGTGTGTTATATAACTTCC-3'     (SEQ ID NO: 6510)

5'-UUUACCGUGUGUUAUAUAACUUCct-3'        (SEQ ID NO: 2483)
                   3'-ACAAAUGGCACACAAUAUAUUGAAGGA-5'      (SEQ ID NO: 4497)
LDHA-1601 Target:  5'-TGTTTACCGTGTGTTATATAACTTCCT-3'     (SEQ ID NO: 6511)

5'-UUACCGUGUGUUAUAUAACUUCCtg-3'        (SEQ ID NO: 2484)
                   3'-CAAAUGGCACACAAUAUAUUGAAGGAC-5'      (SEQ ID NO: 4498)
LDHA-1602 Target:  5'-GTTTACCGTGTGTTATATAACTTCCTG-3'     (SEQ ID NO: 6512)

5'-UACCGUGUGUUAUAUAACUUCCUgg-3'        (SEQ ID NO: 2485)
                   3'-AAAUGGCACACAAUAUAUUGAAGGACC-5'      (SEQ ID NO: 4499)
LDHA-1603 Target:  5'-TTTACCGTGTGTTATATAACTTCCTGG-3'     (SEQ ID NO: 6513)

5'-ACCGUGUGUUAUAUAACUUCCUGgc-3'        (SEQ ID NO: 2486)
                   3'-AAUGGCACACAAUAUAUUGAAGGACCG-5'      (SEQ ID NO: 4500)
LDHA-1604 Target:  5'-TTACCGTGTGTTATATAACTTCCTGGC-3'     (SEQ ID NO: 6514)
```

TABLE 12-continued

Additional Selected Human Anti-Lactate Dehydrogenase DsiRNA Agents (Asymmetrics)

| | | |
|---|---|---|
| | 5'-CCGUGUGUUAUAUAACUUCCUGGct-3' | (SEQ ID NO: 2487) |
| | 3'-AUGGCACACAAUAUAUUGAAGGACCGA-5' | (SEQ ID NO: 4501) |
| LDHA-1605 Target: | 5'-TACCGTGTGTTATATAACTTCCTGGCT-3' | (SEQ ID NO: 6515) |
| | 5'-CGUGUGUUAUAUAACUUCCUGGCtc-3' | (SEQ ID NO: 2488) |
| | 3'-UGGCACACAAUAUAUUGAAGGACCGAG-5' | (SEQ ID NO: 4502) |
| LDHA-1606 Target: | 5'-ACCGTGTGTTATATAACTTCCTGGCTC-3' | (SEQ ID NO: 6516) |
| | 5'-GUGUGUUAUAUAACUUCCUGGCUcc-3' | (SEQ ID NO: 2489) |
| | 3'-GGCACACAAUAUAUUGAAGGACCGAGG-5' | (SEQ ID NO: 4503) |
| LDHA-1607 Target: | 5'-CCGTGTGTTATATAACTTCCTGGCTCC-3' | (SEQ ID NO: 6517) |
| | 5'-UGUGUUAUAUAACUUCCUGGCUCct-3' | (SEQ ID NO: 2490) |
| | 3'-GCACACAAUAUAUUGAAGGACCGAGGA-5' | (SEQ ID NO: 4504) |
| LDHA-1608 Target: | 5'-CGTGTGTTATATAACTTCCTGGCTCCT-3' | (SEQ ID NO: 6518) |
| | 5'-GUGUUAUAUAACUUCCUGGCUCCtt-3' | (SEQ ID NO: 2491) |
| | 3'-CACACAAUAUAUUGAAGGACCGAGGAA-5' | (SEQ ID NO: 4505) |
| LDHA-1609 Target: | 5'-GTGTGTTATATAACTTCCTGGCTCCTT-3' | (SEQ ID NO: 6519) |
| | 5'-UGUUAUAUAACUUCCUGGCUCCUtc-3' | (SEQ ID NO: 2492) |
| | 3'-ACACAAUAUAUUGAAGGACCGAGGAAG-5' | (SEQ ID NO: 4506) |
| LDHA-1610 Target: | 5'-TGTGTTATATAACTTCCTGGCTCCTTC-3' | (SEQ ID NO: 6520) |
| | 5'-GUUAUAUAACUUCCUGGCUCCUUca-3' | (SEQ ID NO: 2493) |
| | 3'-CACAAUAUAUUGAAGGACCGAGGAAGU-5' | (SEQ ID NO: 4507) |
| LDHA-1611 Target: | 5'-GTGTTATATAACTTCCTGGCTCCTTCA-3' | (SEQ ID NO: 6521) |
| | 5'-UUAUAUAACUUCCUGGCUCCUUCac-3' | (SEQ ID NO: 2494) |
| | 3'-ACAAUAUAUUGAAGGACCGAGGAAGUG-5' | (SEQ ID NO: 4508) |
| LDHA-1612 Target: | 5'-TGTTATATAACTTCCTGGCTCCTTCAC-3' | (SEQ ID NO: 6522) |
| | 5'-UAUAUAACUUCCUGGCUCCUUCAct-3' | (SEQ ID NO: 2495) |
| | 3'-CAAUAUAUUGAAGGACCGAGGAAGUGA-5' | (SEQ ID NO: 4509) |
| LDHA-1613 Target: | 5'-GTTATATAACTTCCTGGCTCCTTCACT-3' | (SEQ ID NO: 6523) |
| | 5'-AUAUAACUUCCUGGCUCCUUCACtg-3' | (SEQ ID NO: 2496) |
| | 3'-AAUAUAUUGAAGGACCGAGGAAGUGAC-5' | (SEQ ID NO: 4510) |
| LDHA-1614 Target: | 5'-TTATATAACTTCCTGGCTCCTTCACTG-3' | (SEQ ID NO: 6524) |
| | 5'-UAUAACUUCCUGGCUCCUUCACUga-3' | (SEQ ID NO: 2497) |
| | 3'-AUAUAUUGAAGGACCGAGGAAGUGACU-5' | (SEQ ID NO: 4511) |
| LDHA-1615 Target: | 5'-TATATAACTTCCTGGCTCCTTCACTGA-3' | (SEQ ID NO: 6525) |
| | 5'-AUAACUUCCUGGCUCCUUCACUGaa-3' | (SEQ ID NO: 2498) |
| | 3'-UAUAUUGAAGGACCGAGGAAGUGACUU-5' | (SEQ ID NO: 4512) |
| LDHA-1616 Target: | 5'-ATATAACTTCCTGGCTCCTTCACTGAA-3' | (SEQ ID NO: 6526) |
| | 5'-UAACUUCCUGGCUCCUUCACUGAac-3' | (SEQ ID NO: 2499) |
| | 3'-AUAUUGAAGGACCGAGGAAGUGACUUG-5' | (SEQ ID NO: 4513) |
| LDHA-1617 Target: | 5'-TATAACTTCCTGGCTCCTTCACTGAAC-3' | (SEQ ID NO: 6527) |
| | 5'-AACUUCCUGGCUCCUUCACUGAAca-3' | (SEQ ID NO: 2500) |
| | 3'-UAUUGAAGGACCGAGGAAGUGACUUGU-5' | (SEQ ID NO: 4514) |
| LDHA-1618 Target: | 5'-ATAACTTCCTGGCTCCTTCACTGAACA-3' | (SEQ ID NO: 6528) |
| | 5'-ACUUCCUGGCUCCUUCACUGAACat-3' | (SEQ ID NO: 2501) |
| | 3'-AUUGAAGGACCGAGGAAGUGACUUGUA-5' | (SEQ ID NO: 4515) |
| LDHA-1619 Target: | 5'-TAACTTCCTGGCTCCTTCACTGAACAT-3' | (SEQ ID NO: 6529) |
| | 5'-CUUCCUGGCUCCUUCACUGAACAtg-3' | (SEQ ID NO: 2502) |
| | 3'-UUGAAGGACCGAGGAAGUGACUUGUAC-5' | (SEQ ID NO: 4516) |
| LDHA-1620 Target: | 5'-AACTTCCTGGCTCCTTCACTGAACATG-3' | (SEQ ID NO: 6530) |
| | 5'-UUCCUGGCUCCUUCACUGAACAUgc-3' | (SEQ ID NO: 2503) |
| | 3'-UGAAGGACCGAGGAAGUGACUUGUACG-5' | (SEQ ID NO: 4517) |
| LDHA-1621 Target: | 5'-ACTTCCTGGCTCCTTCACTGAACATGC-3' | (SEQ ID NO: 6531) |
| | 5'-UCCUGGCUCCUUCACUGAACAUGcc-3' | (SEQ ID NO: 2504) |
| | 3'-GAAGGACCGAGGAAGUGACUUGUACGG-5' | (SEQ ID NO: 4518) |
| LDHA-1622 Target: | 5'-CTTCCTGGCTCCTTCACTGAACATGCC-3' | (SEQ ID NO: 6532) |
| | 5'-CCUGGCUCCUUCACUGAACAUGCct-3' | (SEQ ID NO: 2505) |
| | 3'-AAGGACCGAGGAAGUGACUUGUACGGA-5' | (SEQ ID NO: 4519) |
| LDHA-1623 Target: | 5'-TTCCTGGCTCCTTCACTGAACATGCCT-3' | (SEQ ID NO: 6533) |

TABLE 12-continued

Additional Selected Human Anti-Lactate Dehydrogenase DsiRNA Agents (Asymmetrics)

|   |   |   |
|---|---|---|
| | 5'-CUGGCUCCUUCACUGAACAUGCCta-3' | (SEQ ID NO: 2506) |
| | 3'-AGGACCGAGGAAGUGACUUGUACGGAU-5' | (SEQ ID NO: 4520) |
| LDHA-1624 Target: | 5'-TCCTGGCTCCTTCACTGAACATGCCTA-3' | (SEQ ID NO: 6534) |
| | 5'-UGGCUCCUUCACUGAACAUGCCUag-3' | (SEQ ID NO: 2507) |
| | 3'-GGACCGAGGAAGUGACUUGUACGGAUC-5' | (SEQ ID NO: 4521) |
| LDHA-1625 Target: | 5'-CCTGGCTCCTTCACTGAACATGCCTAG-3' | (SEQ ID NO: 6535) |
| | 5'-GGCUCCUUCACUGAACAUGCCUAgt-3' | (SEQ ID NO: 2508) |
| | 3'-GACCGAGGAAGUGACUUGUACGGAUCA-5' | (SEQ ID NO: 4522) |
| LDHA-1626 Target: | 5'-CTGGCTCCTTCACTGAACATGCCTAGT-3' | (SEQ ID NO: 6536) |
| | 5'-GCUCCUUCACUGAACAUGCCUAGtc-3' | (SEQ ID NO: 2509) |
| | 3'-ACCGAGGAAGUGACUUGUACGGAUCAG-5' | (SEQ ID NO: 4523) |
| LDHA-1627 Target: | 5'-TGGCTCCTTCACTGAACATGCCTAGTC-3' | (SEQ ID NO: 6537) |
| | 5'-CUCCUUCACUGAACAUGCCUAGUcc-3' | (SEQ ID NO: 2510) |
| | 3'-CCGAGGAAGUGACUUGUACGGAUCAGG-5' | (SEQ ID NO: 4524) |
| LDHA-1628 Target: | 5'-GGCTCCTTCACTGAACATGCCTAGTCC-3' | (SEQ ID NO: 6538) |
| | 5'-UCCUUCACUGAACAUGCCUAGUCca-3' | (SEQ ID NO: 2511) |
| | 3'-CGAGGAAGUGACUUGUACGGAUCAGGU-5' | (SEQ ID NO: 4525) |
| LDHA-1629 Target: | 5'-GCTCCTTCACTGAACATGCCTAGTCCA-3' | (SEQ ID NO: 6539) |
| | 5'-CCUUCACUGAACAUGCCUAGUCCaa-3' | (SEQ ID NO: 2512) |
| | 3'-GAGGAAGUGACUUGUACGGAUCAGGUU-5' | (SEQ ID NO: 4526) |
| LDHA-1630 Target: | 5'-CTCCTTCACTGAACATGCCTAGTCCAA-3' | (SEQ ID NO: 6540) |
| | 5'-CUUCACUGAACAUGCCUAGUCCAac-3' | (SEQ ID NO: 2513) |
| | 3'-AGGAAGUGACUUGUACGGAUCAGGUUG-5' | (SEQ ID NO: 4527) |
| LDHA-1631 Target: | 5'-TCCTTCACTGAACATGCCTAGTCCAAC-3' | (SEQ ID NO: 6541) |
| | 5'-UUCACUGAACAUGCCUAGUCCAAca-3' | (SEQ ID NO: 2514) |
| | 3'-GGAAGUGACUUGUACGGAUCAGGUUGU-5' | (SEQ ID NO: 4528) |
| LDHA-1632 Target: | 5'-CCTTCACTGAACATGCCTAGTCCAACA-3' | (SEQ ID NO: 6542) |
| | 5'-UCACUGAACAUGCCUAGUCCAACat-3' | (SEQ ID NO: 2515) |
| | 3'-GAAGUGACUUGUACGGAUCAGGUUGUA-5' | (SEQ ID NO: 4529) |
| LDHA-1633 Target: | 5'-CTTCACTGAACATGCCTAGTCCAACAT-3' | (SEQ ID NO: 6543) |
| | 5'-CACUGAACAUGCCUAGUCCAACAtt-3' | (SEQ ID NO: 2516) |
| | 3'-AAGUGACUUGUACGGAUCAGGUUGUAA-5' | (SEQ ID NO: 4530) |
| LDHA-1634 Target: | 5'-TTCACTGAACATGCCTAGTCCAACATT-3' | (SEQ ID NO: 6544) |
| | 5'-ACUGAACAUGCCUAGUCCAACAUtt-3' | (SEQ ID NO: 2517) |
| | 3'-AGUGACUUGUACGGAUCAGGUUGUAAA-5' | (SEQ ID NO: 4531) |
| LDHA-1635 Target: | 5'-TCACTGAACATGCCTAGTCCAACATTT-3' | (SEQ ID NO: 6545) |
| | 5'-CUGAACAUGCCUAGUCCAACAUUtt-3' | (SEQ ID NO: 2518) |
| | 3'-GUGACUUGUACGGAUCAGGUUGUAAAA-5' | (SEQ ID NO: 4532) |
| LDHA-1636 Target: | 5'-CACTGAACATGCCTAGTCCAACATTTT-3' | (SEQ ID NO: 6546) |
| | 5'-UGAACAUGCCUAGUCCAACAUUUtt-3' | (SEQ ID NO: 2519) |
| | 3'-UGACUUGUACGGAUCAGGUUGUAAAAA-5' | (SEQ ID NO: 4533) |
| LDHA-1637 Target: | 5'-ACTGAACATGCCTAGTCCAACATTTTT-3' | (SEQ ID NO: 6547) |
| | 5'-GAACAUGCCUAGUCCAACAUUUUtt-3' | (SEQ ID NO: 2520) |
| | 3'-GACUUGUACGGAUCAGGUUGUAAAAAA-5' | (SEQ ID NO: 4534) |
| LDHA-1638 Target: | 5'-CTGAACATGCCTAGTCCAACATTTTTT-3' | (SEQ ID NO: 6548) |
| | 5'-AACAUGCCUAGUCCAACAUUUUUtc-3' | (SEQ ID NO: 2521) |
| | 3'-ACUUGUACGGAUCAGGUUGUAAAAAAG-5' | (SEQ ID NO: 4535) |
| LDHA-1639 Target: | 5'-TGAACATGCCTAGTCCAACATTTTTTC-3' | (SEQ ID NO: 6549) |
| | 5'-ACAUGCCUAGUCCAACAUUUUUUcc-3' | (SEQ ID NO: 2522) |
| | 3'-CUUGUACGGAUCAGGUUGUAAAAAAGG-5' | (SEQ ID NO: 4536) |
| LDHA-1640 Target: | 5'-GAACATGCCTAGTCCAACATTTTTTCC-3' | (SEQ ID NO: 6550) |
| | 5'-CAUGCCUAGUCCAACAUUUUUUCcc-3' | (SEQ ID NO: 2523) |
| | 3'-UUGUACGGAUCAGGUUGUAAAAAAGGG-5' | (SEQ ID NO: 4537) |
| LDHA-1641 Target: | 5'-AACATGCCTAGTCCAACATTTTTTCCC-3' | (SEQ ID NO: 6551) |
| | 5'-AUGCCUAGUCCAACAUUUUUUCCca-3' | (SEQ ID NO: 2524) |
| | 3'-UGUACGGAUCAGGUUGUAAAAAAGGGU-5' | (SEQ ID NO: 4538) |
| LDHA-1642 Target: | 5'-ACATGCCTAGTCCAACATTTTTTCCCA-3' | (SEQ ID NO: 6552) |

TABLE 12-continued

Additional Selected Human Anti-Lactate Dehydrogenase DsiRNA Agents (Asymmetrics)

|  |  |  |
| --- | --- | --- |
| LDHA-1643 | 5'-UGCCUAGUCCAACAUUUUUUCCCag-3'<br>3'-GUACGGAUCAGGUUGUAAAAAAGGGUC-5'<br>Target: 5'-CATGCCTAGTCCAACATTTTTTCCCAG-3' | (SEQ ID NO: 2525)<br>(SEQ ID NO: 4539)<br>(SEQ ID NO: 6553) |
| LDHA-1644 | 5'-GCCUAGUCCAACAUUUUUUCCCAgt-3'<br>3'-UACGGAUCAGGUUGUAAAAAAGGGUCA-5'<br>Target: 5'-ATGCCTAGTCCAACATTTTTTCCCAGT-3' | (SEQ ID NO: 2526)<br>(SEQ ID NO: 4540)<br>(SEQ ID NO: 6554) |
| LDHA-1645 | 5'-CCUAGUCCAACAUUUUUUCCCAGtg-3'<br>3'-ACGGAUCAGGUUGUAAAAAAGGGUCAC-5'<br>Target: 5'-TGCCTAGTCCAACATTTTTTCCCAGTG-3' | (SEQ ID NO: 2527)<br>(SEQ ID NO: 4541)<br>(SEQ ID NO: 6555) |
| LDHA-1646 | 5'-CUAGUCCAACAUUUUUUCCCAGUga-3'<br>3'-CGGAUCAGGUUGUAAAAAAGGGUCACU-5'<br>Target: 5'-GCCTAGTCCAACATTTTTTCCCAGTGA-3' | (SEQ ID NO: 2528)<br>(SEQ ID NO: 4542)<br>(SEQ ID NO: 6556) |
| LDHA-1647 | 5'-UAGUCCAACAUUUUUUCCCAGUGag-3'<br>3'-GGAUCAGGUUGUAAAAAAGGGUCACUC-5'<br>Target: 5'-CCTAGTCCAACATTTTTTCCCAGTGAG-3' | (SEQ ID NO: 2529)<br>(SEQ ID NO: 4543)<br>(SEQ ID NO: 6557) |
| LDHA-1648 | 5'-AGUCCAACAUUUUUUCCCAGUGAgt-3'<br>3'-GAUCAGGUUGUAAAAAAGGGUCACUCA-5'<br>Target: 5'-CTAGTCCAACATTTTTTCCCAGTGAGT-3' | (SEQ ID NO: 2530)<br>(SEQ ID NO: 4544)<br>(SEQ ID NO: 6558) |
| LDHA-1649 | 5'-GUCCAACAUUUUUUCCCAGUGAgtc-3'<br>3'-AUCAGGUUGUAAAAAAGGGUCACUCAG-5'<br>Target: 5'-TAGTCCAACATTTTTTCCCAGTGAGTC-3' | (SEQ ID NO: 2531)<br>(SEQ ID NO: 4545)<br>(SEQ ID NO: 6559) |
| LDHA-1650 | 5'-UCCAACAUUUUUUCCCAGUGAGUca-3'<br>3'-UCAGGUUGUAAAAAAGGGUCACUCAGU-5'<br>Target: 5'-AGTCCAACATTTTTTCCCAGTGAGTCA-3' | (SEQ ID NO: 2532)<br>(SEQ ID NO: 4546)<br>(SEQ ID NO: 6560) |
| LDHA-1651 | 5'-CCAACAUUUUUUCCCAGUGAGUCac-3'<br>3'-CAGGUUGUAAAAAAGGGUCACUCAGUG-5'<br>Target: 5'-GTCCAACATTTTTTCCCAGTGAGTCAC-3' | (SEQ ID NO: 2533)<br>(SEQ ID NO: 4547)<br>(SEQ ID NO: 6561) |
| LDHA-1652 | 5'-CAACAUUUUUUCCCAGUGAGUCAca-3'<br>3'-AGGUUGUAAAAAAGGGUCACUCAGUGU-5'<br>Target: 5'-TCCAACATTTTTTCCCAGTGAGTCACA-3' | (SEQ ID NO: 2534)<br>(SEQ ID NO: 4548)<br>(SEQ ID NO: 6562) |
| LDHA-1653 | 5'-AACAUUUUUUCCCAGUGAGUCACat-3'<br>3'-GGUUGUAAAAAAGGGUCACUCAGUGUA-5'<br>Target: 5'-CCAACATTTTTTCCCAGTGAGTCACAT-3' | (SEQ ID NO: 2535)<br>(SEQ ID NO: 4549)<br>(SEQ ID NO: 6563) |
| LDHA-1654 | 5'-ACAUUUUUUCCCAGUGAGUCACAtc-3'<br>3'-GUUGUAAAAAAGGGUCACUCAGUGUAG-5'<br>Target: 5'-CAACATTTTTTCCCAGTGAGTCACATC-3' | (SEQ ID NO: 2536)<br>(SEQ ID NO: 4550)<br>(SEQ ID NO: 6564) |
| LDHA-1655 | 5'-CAUUUUUUCCCAGUGAGUCACAUcc-3'<br>3'-UUGUAAAAAAGGGUCACUCAGUGUAGG-5'<br>Target: 5'-AACATTTTTTCCCAGTGAGTCACATCC-3' | (SEQ ID NO: 2537)<br>(SEQ ID NO: 4551)<br>(SEQ ID NO: 6565) |
| LDHA-1656 | 5'-AUUUUUUCCCAGUGAGUCACAUCct-3'<br>3'-UGUAAAAAAGGGUCACUCAGUGUAGGA-5'<br>Target: 5'-ACATTTTTTCCCAGTGAGTCACATCCT-3' | (SEQ ID NO: 2538)<br>(SEQ ID NO: 4552)<br>(SEQ ID NO: 6566) |
| LDHA-1657 | 5'-UUUUUUCCCAGUGAGUCACAUCCtg-3'<br>3'-GUAAAAAAGGGUCACUCAGUGUAGGAC-5'<br>Target: 5'-CATTTTTTCCCAGTGAGTCACATCCTG-3' | (SEQ ID NO: 2539)<br>(SEQ ID NO: 4553)<br>(SEQ ID NO: 6567) |
| LDHA-1658 | 5'-UUUUUCCCAGUGAGUCACAUCCUgg-3'<br>3'-UAAAAAAGGGUCACUCAGUGUAGGACC-5'<br>Target: 5'-ATTTTTTCCCAGTGAGTCACATCCTGG-3' | (SEQ ID NO: 2540)<br>(SEQ ID NO: 4554)<br>(SEQ ID NO: 6568) |
| LDHA-1659 | 5'-UUUUCCCAGUGAGUCACAUCCUGgg-3'<br>3'-AAAAAAGGGUCACUCAGUGUAGGACCC-5'<br>Target: 5'-TTTTTTCCCAGTGAGTCACATCCTGGG-3' | (SEQ ID NO: 2541)<br>(SEQ ID NO: 4555)<br>(SEQ ID NO: 6569) |
| LDHA-1660 | 5'-UUUCCCAGUGAGUCACAUCCUGGga-3'<br>3'-AAAAAGGGUCACUCAGUGUAGGACCCU-5'<br>Target: 5'-TTTTTCCCAGTGAGTCACATCCTGGGA-3' | (SEQ ID NO: 2542)<br>(SEQ ID NO: 4556)<br>(SEQ ID NO: 6570) |
| LDHA-1661 | 5'-UUCCCAGUGAGUCACAUCCUGGGat-3'<br>3'-AAAAGGGUCACUCAGUGUAGGACCCUA-5'<br>Target: 5'-TTTTCCCAGTGAGTCACATCCTGGGAT-3' | (SEQ ID NO: 2543)<br>(SEQ ID NO: 4557)<br>(SEQ ID NO: 6571) |

TABLE 12-continued

Additional Selected Human Anti-Lactate Dehydrogenase DsiRNA Agents (Asymmetrics)

|  |  |  |
|---|---|---|
| LDHA-1662 | 5'-UCCCAGUGAGUCACAUCCUGGGAtc-3'<br>3'-AAAGGGUCACUCAGUGUAGGACCCUAG-5'<br>Target: 5'-TTTCCCAGTGAGTCACATCCTGGGATC-3' | (SEQ ID NO: 2544)<br>(SEQ ID NO: 4558)<br>(SEQ ID NO: 6572) |
| LDHA-1663 | 5'-CCCAGUGAGUCACAUCCUGGGAUcc-3'<br>3'-AAGGGUCACUCAGUGUAGGACCCUAGG-5'<br>Target: 5'-TTCCCAGTGAGTCACATCCTGGGATCC-3' | (SEQ ID NO: 2545)<br>(SEQ ID NO: 4559)<br>(SEQ ID NO: 6573) |
| LDHA-1664 | 5'-CCAGUGAGUCACAUCCUGGGAUCca-3'<br>3'-AGGGUCACUCAGUGUAGGACCCUAGGU-5'<br>Target: 5'-TCCCAGTGAGTCACATCCTGGGATCCA-3' | (SEQ ID NO: 2546)<br>(SEQ ID NO: 4560)<br>(SEQ ID NO: 6574) |
| LDHA-1665 | 5'-CAGUGAGUCACAUCCUGGGAUCCag-3'<br>3'-GGGUCACUCAGUGUAGGACCCUAGGUC-5'<br>Target: 5'-CCCAGTGAGTCACATCCTGGGATCCAG-3' | (SEQ ID NO: 2547)<br>(SEQ ID NO: 4561)<br>(SEQ ID NO: 6575) |
| LDHA-1666 | 5'-AGUGAGUCACAUCCUGGGAUCCAgt-3'<br>3'-GGUCACUCAGUGUAGGACCCUAGGUCA-5'<br>Target: 5'-CCAGTGAGTCACATCCTGGGATCCAGT-3' | (SEQ ID NO: 2548)<br>(SEQ ID NO: 4562)<br>(SEQ ID NO: 6576) |
| LDHA-1667 | 5'-GUGAGUCACAUCCUGGGAUCCAGtg-3'<br>3'-GUCACUCAGUGUAGGACCCUAGGUCAC-5'<br>Target: 5'-CAGTGAGTCACATCCTGGGATCCAGTG-3' | (SEQ ID NO: 2549)<br>(SEQ ID NO: 4563)<br>(SEQ ID NO: 6577) |
| LDHA-1668 | 5'-UGAGUCACAUCCUGGGAUCCAGUgt-3'<br>3'-UCACUCAGUGUAGGACCCUAGGUCACA-5'<br>Target: 5'-AGTGAGTCACATCCTGGGATCCAGTGT-3' | (SEQ ID NO: 2550)<br>(SEQ ID NO: 4564)<br>(SEQ ID NO: 6578) |
| LDHA-1669 | 5'-GAGUCACAUCCUGGGAUCCAGUGta-3'<br>3'-CACUCAGUGUAGGACCCUAGGUCACAU-5'<br>Target: 5'-GTGAGTCACATCCTGGGATCCAGTGTA-3' | (SEQ ID NO: 2551)<br>(SEQ ID NO: 4565)<br>(SEQ ID NO: 6579) |
| LDHA-1670 | 5'-AGUCACAUCCUGGGAUCCAGUGUat-3'<br>3'-ACUCAGUGUAGGACCCUAGGUCACAUA-5'<br>Target: 5'-TGAGTCACATCCTGGGATCCAGTGTAT-3' | (SEQ ID NO: 2552)<br>(SEQ ID NO: 4566)<br>(SEQ ID NO: 6580) |
| LDHA-1671 | 5'-GUCACAUCCUGGGAUCCAGUGUAta-3'<br>3'-CUCAGUGUAGGACCCUAGGUCACAUAU-5'<br>Target: 5'-GAGTCACATCCTGGGATCCAGTGTATA-3' | (SEQ ID NO: 2553)<br>(SEQ ID NO: 4567)<br>(SEQ ID NO: 6581) |
| LDHA-1672 | 5'-UCACAUCCUGGGAUCCAGUGUAUaa-3'<br>3'-UCAGUGUAGGACCCUAGGUCACAUAUU-5'<br>Target: 5'-AGTCACATCCTGGGATCCAGTGTATAA-3' | (SEQ ID NO: 2554)<br>(SEQ ID NO: 4568)<br>(SEQ ID NO: 6582) |
| LDHA-1673 | 5'-CACAUCCUGGGAUCCAGUGUAUAaa-3'<br>3'-CAGUGUAGGACCCUAGGUCACAUAUUU-5'<br>Target: 5'-GTCACATCCTGGGATCCAGTGTATAAA-3' | (SEQ ID NO: 2555)<br>(SEQ ID NO: 4569)<br>(SEQ ID NO: 6583) |
| LDHA-1674 | 5'-ACAUCCUGGGAUCCAGUGUAUAAat-3'<br>3'-AGUGUAGGACCCUAGGUCACAUAUUUA-5'<br>Target: 5'-TCACATCCTGGGATCCAGTGTATAAAT-3' | (SEQ ID NO: 2556)<br>(SEQ ID NO: 4570)<br>(SEQ ID NO: 6584) |
| LDHA-1675 | 5'-CAUCCUGGGAUCCAGUGUAUAAAtc-3'<br>3'-GUGUAGGACCCUAGGUCACAUAUUUAG-5'<br>Target: 5'-CACATCCTGGGATCCAGTGTATAAATC-3' | (SEQ ID NO: 2557)<br>(SEQ ID NO: 4571)<br>(SEQ ID NO: 6585) |
| LDHA-1676 | 5'-AUCCUGGGAUCCAGUGUAUAAAUcc-3'<br>3'-UGUAGGACCCUAGGUCACAUAUUUAGG-5'<br>Target: 5'-ACATCCTGGGATCCAGTGTATAAATCC-3' | (SEQ ID NO: 2558)<br>(SEQ ID NO: 4572)<br>(SEQ ID NO: 6586) |
| LDHA-1677 | 5'-UCCUGGGAUCCAGUGUAUAAAUCca-3'<br>3'-GUAGGACCCUAGGUCACAUAUUUAGGU-5'<br>Target: 5'-CATCCTGGGATCCAGTGTATAAATCCA-3' | (SEQ ID NO: 2559)<br>(SEQ ID NO: 4573)<br>(SEQ ID NO: 6587) |
| LDHA-1678 | 5'-CCUGGGAUCCAGUGUAUAAAUCCaa-3'<br>3'-UAGGACCCUAGGUCACAUAUUUAGGUU-5'<br>Target: 5'-ATCCTGGGATCCAGTGTATAAATCCAA-3' | (SEQ ID NO: 2560)<br>(SEQ ID NO: 4574)<br>(SEQ ID NO: 6588) |
| LDHA-1679 | 5'-CUGGGAUCCAGUGUAUAAAUCCAat-3'<br>3'-AGGACCCUAGGUCACAUAUUUAGGUUA-5'<br>Target: 5'-TCCTGGGATCCAGTGTATAAATCCAAT-3' | (SEQ ID NO: 2561)<br>(SEQ ID NO: 4575)<br>(SEQ ID NO: 6589) |
| LDHA-1680 | 5'-UGGGAUCCAGUGUAUAAAUCCAAta-3'<br>3'-GGACCCUAGGUCACAUAUUUAGGUUAU-5'<br>Target: 5'-CCTGGGATCCAGTGTATAAATCCAATA-3' | (SEQ ID NO: 2562)<br>(SEQ ID NO: 4576)<br>(SEQ ID NO: 6590) |

TABLE 12-continued

Additional Selected Human Anti-Lactate Dehydrogenase DsiRNA Agents (Asymmetrics)

|  |  |  |
|---|---|---|
| LDHA-1681 | 5'-GGGAUCCAGUGUAUAAAUCCAAUat-3'<br>3'-GACCCUAGGUCACAUAUUUAGGUUAUA-5'<br>Target: 5'-CTGGGATCCAGTGTATAAATCCAATAT-3' | (SEQ ID NO: 2563)<br>(SEQ ID NO: 4577)<br>(SEQ ID NO: 6591) |
| LDHA-1682 | 5'-GGAUCCAGUGUAUAAAUCCAAUAtc-3'<br>3'-ACCCUAGGUCACAUAUUUAGGUUAUAG-5'<br>Target: 5'-TGGGATCCAGTGTATAAATCCAATATC-3' | (SEQ ID NO: 2564)<br>(SEQ ID NO: 4578)<br>(SEQ ID NO: 6592) |
| LDHA-1683 | 5'-GAUCCAGUGUAUAAAUCCAAUAUca-3'<br>3'-CCCUAGGUCACAUAUUUAGGUUAUAGU-5'<br>Target: 5'-GGGATCCAGTGTATAAATCCAATATCA-3' | (SEQ ID NO: 2565)<br>(SEQ ID NO: 4579)<br>(SEQ ID NO: 6593) |
| LDHA-1685 | 5'-UCCAGUGUAUAAAUCCAAUAUCAtg-3'<br>3'-CUAGGUCACAUAUUUAGGUUAUAGUAC-5'<br>Target: 5'-GATCCAGTGTATAAATCCAATATCATG-3' | (SEQ ID NO: 2566)<br>(SEQ ID NO: 4580)<br>(SEQ ID NO: 6594) |
| LDHA-1686 | 5'-CCAGUGUAUAAAUCCAAUAUCAUgt-3'<br>3'-UAGGUCACAUAUUUAGGUUAUAGUACA-5'<br>Target: 5'-ATCCAGTGTATAAATCCAATATCATGT-3' | (SEQ ID NO: 2567)<br>(SEQ ID NO: 4581)<br>(SEQ ID NO: 6595) |
| LDHA-1687 | 5'-CAGUGUAUAAAUCCAAUAUCAUGtc-3'<br>3'-AGGUCACAUAUUUAGGUUAUAGUACAG-5'<br>Target: 5'-TCCAGTGTATAAATCCAATATCATGTC-3' | (SEQ ID NO: 2568)<br>(SEQ ID NO: 4582)<br>(SEQ ID NO: 6596) |
| LDHA-1689 | 5'-GUGUAUAAAUCCAAUAUCAUGUCtt-3'<br>3'-GUCACAUAUUUAGGUUAUAGUACAGAA-5'<br>Target: 5'-CAGTGTATAAATCCAATATCATGTCTT-3' | (SEQ ID NO: 2569)<br>(SEQ ID NO: 4583)<br>(SEQ ID NO: 6597) |
| LDHA-1690 | 5'-UGUAUAAAUCCAAUAUCAUGUCUtg-3'<br>3'-UCACAUAUUUAGGUUAUAGUACAGAAC-5'<br>Target: 5'-AGTGTATAAATCCAATATCATGTCTTG-3' | (SEQ ID NO: 2570)<br>(SEQ ID NO: 4584)<br>(SEQ ID NO: 6598) |
| LDHA-1691 | 5'-GUAUAAAUCCAAUAUCAUGUCUUgt-3'<br>3'-CACAUAUUUAGGUUAUAGUACAGAACA-5'<br>Target: 5'-GTGTATAAATCCAATATCATGTCTTGT-3' | (SEQ ID NO: 2571)<br>(SEQ ID NO: 4585)<br>(SEQ ID NO: 6599) |
| LDHA-1692 | 5'-UAUAAAUCCAAUAUCAUGUCUUGtg-3'<br>3'-ACAUAUUUAGGUUAUAGUACAGAACAC-5'<br>Target: 5'-TGTATAAATCCAATATCATGTCTTGTG-3' | (SEQ ID NO: 2572)<br>(SEQ ID NO: 4586)<br>(SEQ ID NO: 6600) |
| LDHA-1693 | 5'-AUAAAUCCAAUAUCAUGUCUUGUgc-3'<br>3'-CAUAUUUAGGUUAUAGUACAGAACACG-5'<br>Target: 5'-GTATAAATCCAATATCATGTCTTGTGC-3' | (SEQ ID NO: 2573)<br>(SEQ ID NO: 4587)<br>(SEQ ID NO: 6601) |
| LDHA-1694 | 5'-UAAAUCCAAUAUCAUGUCUUGUGca-3'<br>3'-AUAUUUAGGUUAUAGUACAGAACACGU-5'<br>Target: 5'-TATAAATCCAATATCATGTCTTGTGCA-3' | (SEQ ID NO: 2574)<br>(SEQ ID NO: 4588)<br>(SEQ ID NO: 6602) |
| LDHA-1695 | 5'-AAAUCCAAUAUCAUGUCUUGUGCat-3'<br>3'-UAUUUAGGUUAUAGUACAGAACACGUA-5'<br>Target: 5'-ATAAATCCAATATCATGTCTTGTGCAT-3' | (SEQ ID NO: 2575)<br>(SEQ ID NO: 4589)<br>(SEQ ID NO: 6603) |
| LDHA-1696 | 5'-AAUCCAAUAUCAUGUCUUGUGCAta-3'<br>3'-AUUUAGGUUAUAGUACAGAACACGUAU-5'<br>Target: 5'-TAAATCCAATATCATGTCTTGTGCATA-3' | (SEQ ID NO: 2576)<br>(SEQ ID NO: 4590)<br>(SEQ ID NO: 6604) |
| LDHA-1697 | 5'-AUCCAAUAUCAUGUCUUGUGCAUaa-3'<br>3'-UUUAGGUUAUAGUACAGAACACGUAUU-5'<br>Target: 5'-AAATCCAATATCATGTCTTGTGCATAA-3' | (SEQ ID NO: 2577)<br>(SEQ ID NO: 4591)<br>(SEQ ID NO: 6605) |
| LDHA-1698 | 5'-UCCAAUAUCAUGUCUUGUGCAUAat-3'<br>3'-UUAGGUUAUAGUACAGAACACGUAUUA-5'<br>Target: 5'-AATCCAATATCATGTCTTGTGCATAAT-3' | (SEQ ID NO: 2578)<br>(SEQ ID NO: 4592)<br>(SEQ ID NO: 6606) |
| LDHA-1699 | 5'-CCAAUAUCAUGUCUUGUGCAUAAtt-3'<br>3'-UAGGUUAUAGUACAGAACACGUAUUAA-5'<br>Target: 5'-ATCCAATATCATGTCTTGTGCATAATT-3' | (SEQ ID NO: 2579)<br>(SEQ ID NO: 4593)<br>(SEQ ID NO: 6607) |
| LDHA-1700 | 5'-CAAUAUCAUGUCUUGUGCAUAAUtc-3'<br>3'-AGGUUAUAGUACAGAACACGUAUUAAG-5'<br>Target: 5'-TCCAATATCATGTCTTGTGCATAATTC-3' | (SEQ ID NO: 2580)<br>(SEQ ID NO: 4594)<br>(SEQ ID NO: 6608) |
| LDHA-1701 | 5'-AAUAUCAUGUCUUGUGCAUAAUUct-3'<br>3'-GGUUAUAGUACAGAACACGUAUUAAGA-5'<br>Target: 5'-CCAATATCATGTCTTGTGCATAATTCT-3' | (SEQ ID NO: 2581)<br>(SEQ ID NO: 4595)<br>(SEQ ID NO: 6609) |

TABLE 12-continued

Additional Selected Human Anti-Lactate Dehydrogenase DsiRNA Agents (Asymmetrics)

|  |  |  |
|---|---|---|
| LDHA-1702 | 5'-AUAUCAUGUCUUGUGCAUAAUUCtt-3'<br>3'-GUUAUAGUACAGAACACGUAUUAAGAA-5'<br>Target: 5'-CAATATCATGTCTTGTGCATAATTCTT-3' | (SEQ ID NO: 2582)<br>(SEQ ID NO: 4596)<br>(SEQ ID NO: 6610) |
| LDHA-1703 | 5'-UAUCAUGUCUUGUGCAUAAUUCUtc-3'<br>3'-UUAUAGUACAGAACACGUAUUAAGAAG-5'<br>Target: 5'-AATATCATGTCTTGTGCATAATTCTTC-3' | (SEQ ID NO: 2583)<br>(SEQ ID NO: 4597)<br>(SEQ ID NO: 6611) |
| LDHA-1704 | 5'-AUCAUGUCUUGUGCAUAAUUCUUcc-3'<br>3'-UAUAGUACAGAACACGUAUUAAGAAGG-5'<br>Target: 5'-ATATCATGTCTTGTGCATAATTCTTCC-3' | (SEQ ID NO: 2584)<br>(SEQ ID NO: 4598)<br>(SEQ ID NO: 6612) |
| LDHA-1705 | 5'-UCAUGUCUUGUGCAUAAUUCUUCca-3'<br>3'-AUAGUACAGAACACGUAUUAAGAAGGU-5'<br>Target: 5'-TATCATGTCTTGTGCATAATTCTTCCA-3' | (SEQ ID NO: 2585)<br>(SEQ ID NO: 4599)<br>(SEQ ID NO: 6613) |
| LDHA-1706 | 5'-CAUGUCUUGUGCAUAAUUCUUCCaa-3'<br>3'-UAGUACAGAACACGUAUUAAGAAGGUU-5'<br>Target: 5'-ATCATGTCTTGTGCATAATTCTTCCAA-3' | (SEQ ID NO: 2586)<br>(SEQ ID NO: 4600)<br>(SEQ ID NO: 6614) |
| LDHA-1707 | 5'-AUGUCUUGUGCAUAAUUCUUCCAaa-3'<br>3'-AGUACAGAACACGUAUUAAGAAGGUUU-5'<br>Target: 5'-TCATGTCTTGTGCATAATTCTTCCAAA-3' | (SEQ ID NO: 2587)<br>(SEQ ID NO: 4601)<br>(SEQ ID NO: 6615) |
| LDHA-1708 | 5'-UGUCUUGUGCAUAAUUCUUCCAAag-3'<br>3'-GUACAGAACACGUAUUAAGAAGGUUUC-5'<br>Target: 5'-CATGTCTTGTGCATAATTCTTCCAAAG-3' | (SEQ ID NO: 2588)<br>(SEQ ID NO: 4602)<br>(SEQ ID NO: 6616) |
| LDHA-1709 | 5'-GUCUUGUGCAUAAUUCUUCCAAAgg-3'<br>3'-UACAGAACACGUAUUAAGAAGGUUUCC-5'<br>Target: 5'-ATGTCTTGTGCATAATTCTTCCAAAGG-3' | (SEQ ID NO: 2589)<br>(SEQ ID NO: 4603)<br>(SEQ ID NO: 6617) |
| LDHA-1710 | 5'-UCUUGUGCAUAAUUCUUCCAAAGga-3'<br>3'-ACAGAACACGUAUUAAGAAGGUUUCCU-5'<br>Target: 5'-TGTCTTGTGCATAATTCTTCCAAAGGA-3' | (SEQ ID NO: 2590)<br>(SEQ ID NO: 4604)<br>(SEQ ID NO: 6618) |
| LDHA-1711 | 5'-CUUGUGCAUAAUUCUUCCAAAGGat-3'<br>3'-CAGAACACGUAUUAAGAAGGUUUCCUA-5'<br>Target: 5'-GTCTTGTGCATAATTCTTCCAAAGGAT-3' | (SEQ ID NO: 2591)<br>(SEQ ID NO: 4605)<br>(SEQ ID NO: 6619) |
| LDHA-1712 | 5'-UUGUGCAUAAUUCUUCCAAAGGAtc-3'<br>3'-AGAACACGUAUUAAGAAGGUUUCCUAG-5'<br>Target: 5'-TCTTGTGCATAATTCTTCCAAAGGATC-3' | (SEQ ID NO: 2592)<br>(SEQ ID NO: 4606)<br>(SEQ ID NO: 6620) |
| LDHA-1713 | 5'-UGUGCAUAAUUCUUCCAAAGGAUct-3'<br>3'-GAACACGUAUUAAGAAGGUUUCCUAGA-5'<br>Target: 5'-CTTGTGCATAATTCTTCCAAAGGATCT-3' | (SEQ ID NO: 2593)<br>(SEQ ID NO: 4607)<br>(SEQ ID NO: 6621) |
| LDHA-1714 | 5'-GUGCAUAAUUCUUCCAAAGGAUCtt-3'<br>3'-AACACGUAUUAAGAAGGUUUCCUAGAA-5'<br>Target: 5'-TTGTGCATAATTCTTCCAAAGGATCTT-3' | (SEQ ID NO: 2594)<br>(SEQ ID NO: 4608)<br>(SEQ ID NO: 6622) |
| LDHA-1715 | 5'-UGCAUAAUUCUUCCAAAGGAUCUta-3'<br>3'-ACACGUAUUAAGAAGGUUUCCUAGAAU-5'<br>Target: 5'-TGTGCATAATTCTTCCAAAGGATCTTA-3' | (SEQ ID NO: 2595)<br>(SEQ ID NO: 4609)<br>(SEQ ID NO: 6623) |
| LDHA-1716 | 5'-GCAUAAUUCUUCCAAAGGAUCUUat-3'<br>3'-CACGUAUUAAGAAGGUUUCCUAGAAUA-5'<br>Target: 5'-GTGCATAATTCTTCCAAAGGATCTTAT-3' | (SEQ ID NO: 2596)<br>(SEQ ID NO: 4610)<br>(SEQ ID NO: 6624) |
| LDHA-1717 | 5'-CAUAAUUCUUCCAAAGGAUCUUAtt-3'<br>3'-ACGUAUUAAGAAGGUUUCCUAGAAUAA-5'<br>Target: 5'-TGCATAATTCTTCCAAAGGATCTTATT-3' | (SEQ ID NO: 2597)<br>(SEQ ID NO: 4611)<br>(SEQ ID NO: 6625) |
| LDHA-1718 | 5'-AUAAUUCUUCCAAAGGAUCUUAUtt-3'<br>3'-CGUAUUAAGAAGGUUUCCUAGAAUAAA-5'<br>Target: 5'-GCATAATTCTTCCAAAGGATCTTATTT-3' | (SEQ ID NO: 2598)<br>(SEQ ID NO: 4612)<br>(SEQ ID NO: 6626) |
| LDHA-1719 | 5'-UAAUUCUUCCAAAGGAUCUUAUUtt-3'<br>3'-GUAUUAAGAAGGUUUCCUAGAAUAAAA-5'<br>Target: 5'-CATAATTCTTCCAAAGGATCTTATTTT-3' | (SEQ ID NO: 2599)<br>(SEQ ID NO: 4613)<br>(SEQ ID NO: 6627) |
| LDHA-1720 | 5'-AAUUCUUCCAAAGGAUCUUAUUUtg-3'<br>3'-UAUUAAGAAGGUUUCCUAGAAUAAAAC-5'<br>Target: 5'-ATAATTCTTCCAAAGGATCTTATTTTG-3' | (SEQ ID NO: 2600)<br>(SEQ ID NO: 4614)<br>(SEQ ID NO: 6628) |

TABLE 12-continued

Additional Selected Human Anti-Lactate Dehydrogenase DsiRNA Agents (Asymmetrics)

|  |  |  |
| --- | --- | --- |
| LDHA-1721 Target: | 5'-AUUCUUCCAAAGGAUCUUAUUUUGgt-3'<br>3'-AUUAAGAAGGUUUCCUAGAAUAAAACA-5'<br>5'-TAATTCTTCCAAAGGATCTTATTTTGT-3' | (SEQ ID NO: 2601)<br>(SEQ ID NO: 4615)<br>(SEQ ID NO: 6629) |
| LDHA-1722 Target: | 5'-UUCUUCCAAAGGAUCUUAUUUUGtg-3'<br>3'-UUAAGAAGGUUUCCUAGAAUAAAACAC-5'<br>5'-AATTCTTCCAAAGGATCTTATTTTGTG-3' | (SEQ ID NO: 2602)<br>(SEQ ID NO: 4616)<br>(SEQ ID NO: 6630) |
| LDHA-1723 Target: | 5'-UCUUCCAAAGGAUCUUAUUUUGUga-3'<br>3'-UAAGAAGGUUUCCUAGAAUAAAACACU-5'<br>5'-ATTCTTCCAAAGGATCTTATTTTGTGA-3' | (SEQ ID NO: 2603)<br>(SEQ ID NO: 4617)<br>(SEQ ID NO: 6631) |
| LDHA-1724 Target: | 5'-CUUCCAAAGGAUCUUAUUUUGUGaa-3'<br>3'-AAGAAGGUUUCCUAGAAUAAAACACUU-5'<br>5'-TTCTTCCAAAGGATCTTATTTTGTGAA-3' | (SEQ ID NO: 2604)<br>(SEQ ID NO: 4618)<br>(SEQ ID NO: 6632) |
| LDHA-1725 Target: | 5'-UUCCAAAGGAUCUUAUUUUGUGAac-3'<br>3'-AGAAGGUUUCCUAGAAUAAAACACUUG-5'<br>5'-TCTTCCAAAGGATCTTATTTTGTGAAC-3' | (SEQ ID NO: 2605)<br>(SEQ ID NO: 4619)<br>(SEQ ID NO: 6633) |
| LDHA-1726 Target: | 5'-UCCAAAGGAUCUUAUUUUGUGAAct-3'<br>3'-GAAGGUUUCCUAGAAUAAAACACUUGA-5'<br>5'-CTTCCAAAGGATCTTATTTTGTGAACT-3' | (SEQ ID NO: 2606)<br>(SEQ ID NO: 4620)<br>(SEQ ID NO: 6634) |
| LDHA-1727 Target: | 5'-CCAAAGGAUCUUAUUUUGUGAACta-3'<br>3'-AAGGUUUCCUAGAAUAAAACACUUGAU-5'<br>5'-TTCCAAAGGATCTTATTTTGTGAACTA-3' | (SEQ ID NO: 2607)<br>(SEQ ID NO: 4621)<br>(SEQ ID NO: 6635) |
| LDHA-1728 Target: | 5'-CAAAGGAUCUUAUUUUGUGAACUat-3'<br>3'-AGGUUUCCUAGAAUAAAACACUUGAUA-5'<br>5'-TCCAAAGGATCTTATTTTGTGAACTAT-3' | (SEQ ID NO: 2608)<br>(SEQ ID NO: 4622)<br>(SEQ ID NO: 6636) |
| LDHA-1729 Target: | 5'-AAAGGAUCUUAUUUUGUGAACUAta-3'<br>3'-GGUUUCCUAGAAUAAAACACUUGAUAU-5'<br>5'-CCAAAGGATCTTATTTTGTGAACTATA-3' | (SEQ ID NO: 2609)<br>(SEQ ID NO: 4623)<br>(SEQ ID NO: 6637) |
| LDHA-1730 Target: | 5'-AAGGAUCUUAUUUUGUGAACUAUat-3'<br>3'-GUUUCCUAGAAUAAAACACUUGAUAUA-5'<br>5'-CAAAGGATCTTATTTTGTGAACTATAT-3' | (SEQ ID NO: 2610)<br>(SEQ ID NO: 4624)<br>(SEQ ID NO: 6638) |
| LDHA-1731 Target: | 5'-AGGAUCUUAUUUUGUGAACUAUAtc-3'<br>3'-UUUCCUAGAAUAAAACACUUGAUAUAG-5'<br>5'-AAAGGATCTTATTTTGTGAACTATATC-3' | (SEQ ID NO: 2611)<br>(SEQ ID NO: 4625)<br>(SEQ ID NO: 6639) |
| LDHA-1732 Target: | 5'-GGAUCUUAUUUUGUGAACUAUAUca-3'<br>3'-UUCCUAGAAUAAAACACUUGAUAUAGU-5'<br>5'-AAGGATCTTATTTTGTGAACTATATCA-3' | (SEQ ID NO: 2612)<br>(SEQ ID NO: 4626)<br>(SEQ ID NO: 6640) |
| LDHA-1733 Target: | 5'-GAUCUUAUUUUGUGAACUAUAUCag-3'<br>3'-UCCUAGAAUAAAACACUUGAUAUAGUC-5'<br>5'-AGGATCTTATTTTGTGAACTATATCAG-3' | (SEQ ID NO: 2613)<br>(SEQ ID NO: 4627)<br>(SEQ ID NO: 6641) |
| LDHA-1734 Target: | 5'-AUCUUAUUUUGUGAACUAUAUCAgt-3'<br>3'-CCUAGAAUAAAACACUUGAUAUAGUCA-5'<br>5'-GGATCTTATTTTGTGAACTATATCAGT-3' | (SEQ ID NO: 2614)<br>(SEQ ID NO: 4628)<br>(SEQ ID NO: 6642) |
| LDHA-1735 Target: | 5'-UCUUAUUUUGUGAACUAUAUCAGta-3'<br>3'-CUAGAAUAAAACACUUGAUAUAGUCAU-5'<br>5'-GATCTTATTTTGTGAACTATATCAGTA-3' | (SEQ ID NO: 2615)<br>(SEQ ID NO: 4629)<br>(SEQ ID NO: 6643) |
| LDHA-1737 Target: | 5'-UUAUUUUGUGAACUAUAUCAGUAgt-3'<br>3'-AGAAUAAAACACUUGAUAUAGUCAUCA-5'<br>5'-TCTTATTTTGTGAACTATATCAGTAGT-3' | (SEQ ID NO: 2616)<br>(SEQ ID NO: 4630)<br>(SEQ ID NO: 6644) |
| LDHA-1738 Target: | 5'-UAUUUUGUGAACUAUAUCAGUAGtg-3'<br>3'-GAAUAAAACACUUGAUAUAGUCAUCAC-5'<br>5'-CTTATTTTGTGAACTATATCAGTAGTG-3' | (SEQ ID NO: 2617)<br>(SEQ ID NO: 4631)<br>(SEQ ID NO: 6645) |
| LDHA-1739 Target: | 5'-AUUUUGUGAACUAUAUCAGUAGUgt-3'<br>3'-AAUAAAACACUUGAUAUAGUCAUCACA-5'<br>5'-TTATTTTGTGAACTATATCAGTAGTGT-3' | (SEQ ID NO: 2618)<br>(SEQ ID NO: 4632)<br>(SEQ ID NO: 6646) |
| LDHA-1740 Target: | 5'-UUUUGUGAACUAUAUCAGUAGUGta-3'<br>3'-AUAAAACACUUGAUAUAGUCAUCACAU-5'<br>5'-TATTTTGTGAACTATATCAGTAGTGTA-3' | (SEQ ID NO: 2619)<br>(SEQ ID NO: 4633)<br>(SEQ ID NO: 6647) |

TABLE 12-continued

Additional Selected Human Anti-Lactate Dehydrogenase DsiRNA Agents (Asymmetrics)

|  |  |  |
|---|---|---|
| LDHA-1741 | 5'-UUUGUGAACUAUAUCAGUAGUGUAc-3'<br>3'-UAAAACACUUGAUAUAGUCAUCACAUG-5'<br>Target: 5'-ATTTTGTGAACTATATCAGTAGTGTAC-3' | (SEQ ID NO: 2620)<br>(SEQ ID NO: 4634)<br>(SEQ ID NO: 6648) |
| LDHA-1742 | 5'-UUGUGAACUAUAUCAGUAGUGUAca-3'<br>3'-AAAACACUUGAUAUAGUCAUCACAUGU-5'<br>Target: 5'-TTTTGTGAACTATATCAGTAGTGTACA-3' | (SEQ ID NO: 2621)<br>(SEQ ID NO: 4635)<br>(SEQ ID NO: 6649) |
| LDHA-1743 | 5'-UGUGAACUAUAUCAGUAGUGUACat-3'<br>3'-AAACACUUGAUAUAGUCAUCACAUGUA-5'<br>Target: 5'-TTTGTGAACTATATCAGTAGTGTACAT-3' | (SEQ ID NO: 2622)<br>(SEQ ID NO: 4636)<br>(SEQ ID NO: 6650) |
| LDHA-1744 | 5'-GUGAACUAUAUCAGUAGUGUACAtt-3'<br>3'-AACACUUGAUAUAGUCAUCACAUGUAA-5'<br>Target: 5'-TTGTGAACTATATCAGTAGTGTACATT-3' | (SEQ ID NO: 2623)<br>(SEQ ID NO: 4637)<br>(SEQ ID NO: 6651) |
| LDHA-1745 | 5'-UGAACUAUAUCAGUAGUGUACAUta-3'<br>3'-ACACUUGAUAUAGUCAUCACAUGUAAU-5'<br>Target: 5'-TGTGAACTATATCAGTAGTGTACATTA-3' | (SEQ ID NO: 2624)<br>(SEQ ID NO: 4638)<br>(SEQ ID NO: 6652) |
| LDHA-1746 | 5'-GAACUAUAUCAGUAGUGUACAUUac-3'<br>3'-CACUUGAUAUAGUCAUCACAUGUAAUG-5'<br>Target: 5'-GTGAACTATATCAGTAGTGTACATTAC-3' | (SEQ ID NO: 2625)<br>(SEQ ID NO: 4639)<br>(SEQ ID NO: 6653) |
| LDHA-1747 | 5'-AACUAUAUCAGUAGUGUACAUUAcc-3'<br>3'-ACUUGAUAUAGUCAUCACAUGUAAUGG-5'<br>Target: 5'-TGAACTATATCAGTAGTGTACATTACC-3' | (SEQ ID NO: 2626)<br>(SEQ ID NO: 4640)<br>(SEQ ID NO: 6654) |
| LDHA-1748 | 5'-ACUAUAUCAGUAGUGUACAUUACca-3'<br>3'-CUUGAUAUAGUCAUCACAUGUAAUGGU-5'<br>Target: 5'-GAACTATATCAGTAGTGTACATTACCA-3' | (SEQ ID NO: 2627)<br>(SEQ ID NO: 4641)<br>(SEQ ID NO: 6655) |
| LDHA-1749 | 5'-CUAUAUCAGUAGUGUACAUUACCat-3'<br>3'-UUGAUAUAGUCAUCACAUGUAAUGGUA-5'<br>Target: 5'-AACTATATCAGTAGTGTACATTACCAT-3' | (SEQ ID NO: 2628)<br>(SEQ ID NO: 4642)<br>(SEQ ID NO: 6656) |
| LDHA-1751 | 5'-AUAUCAGUAGUGUACAUUACCAUat-3'<br>3'-GAUAUAGUCAUCACAUGUAAUGGUAUA-5'<br>Target: 5'-CTATATCAGTAGTGTACATTACCATAT-3' | (SEQ ID NO: 2629)<br>(SEQ ID NO: 4643)<br>(SEQ ID NO: 6657) |
| LDHA-1752 | 5'-UAUCAGUAGUGUACAUUACCAUAta-3'<br>3'-AUAUAGUCAUCACAUGUAAUGGUAUAU-5'<br>Target: 5'-TATATCAGTAGTGTACATTACCATATA-3' | (SEQ ID NO: 2630)<br>(SEQ ID NO: 4644)<br>(SEQ ID NO: 6658) |
| LDHA-1755 | 5'-CAGUAGUGUACAUUACCAUAUAAtg-3'<br>3'-UAGUCAUCACAUGUAAUGGUAUAUUAC-5'<br>Target: 5'-ATCAGTAGTGTACATTACCATATAATG-3' | (SEQ ID NO: 2631)<br>(SEQ ID NO: 4645)<br>(SEQ ID NO: 6659) |
| LDHA-1756 | 5'-AGUAGUGUACAUUACCAUAUAAUgt-3'<br>3'-AGUCAUCACAUGUAAUGGUAUAUUACA-5'<br>Target: 5'-TCAGTAGTGTACATTACCATATAATGT-3' | (SEQ ID NO: 2632)<br>(SEQ ID NO: 4646)<br>(SEQ ID NO: 6660) |
| LDHA-1757 | 5'-GUAGUGUACAUUACCAUAUAAUGta-3'<br>3'-GUCAUCACAUGUAAUGGUAUAUUACAU-5'<br>Target: 5'-CAGTAGTGTACATTACCATATAATGTA-3' | (SEQ ID NO: 2633)<br>(SEQ ID NO: 4647)<br>(SEQ ID NO: 6661) |
| LDHA-1758 | 5'-UAGUGUACAUUACCAUAUAAUGUaa-3'<br>3'-UCAUCACAUGUAAUGGUAUAUUACAUU-5'<br>Target: 5'-AGTAGTGTACATTACCATATAATGTAA-3' | (SEQ ID NO: 2634)<br>(SEQ ID NO: 4648)<br>(SEQ ID NO: 6662) |
| LDHA-1759 | 5'-AGUGUACAUUACCAUAUAAUGUAaa-3'<br>3'-CAUCACAUGUAAUGGUAUAUUACAUUU-5'<br>Target: 5'-GTAGTGTACATTACCATATAATGTAAA-3' | (SEQ ID NO: 2635)<br>(SEQ ID NO: 4649)<br>(SEQ ID NO: 6663) |
| LDHA-1760 | 5'-GUGUACAUUACCAUAUAAUGUAAaa-3'<br>3'-AUCACAUGUAAUGGUAUAUUACAUUUU-5'<br>Target: 5'-TAGTGTACATTACCATATAATGTAAAA-3' | (SEQ ID NO: 2636)<br>(SEQ ID NO: 4650)<br>(SEQ ID NO: 6664) |
| LDHA-1761 | 5'-UGUACAUUACCAUAUAAUGUAAAa-3'<br>3'-UCACAUGUAAUGGUAUAUUACAUUUUU-5'<br>Target: 5'-AGTGTACATTACCATATAATGTAAAAA-3' | (SEQ ID NO: 2637)<br>(SEQ ID NO: 4651)<br>(SEQ ID NO: 6665) |
| LDHA-1762 | 5'-GUACAUUACCAUAUAAUGUAAAAg-3'<br>3'-CACAUGUAAUGGUAUAUUACAUUUUUC-5'<br>Target: 5'-GTGTACATTACCATATAATGTAAAAAG-3' | (SEQ ID NO: 2638)<br>(SEQ ID NO: 4652)<br>(SEQ ID NO: 6666) |

TABLE 12-continued

Additional Selected Human Anti-Lactate Dehydrogenase DsiRNA
Agents (Asymmetrics)

```
                   5'-UACAUUACCAUAUAAUGUAAAAAga-3'      (SEQ ID NO: 2639)
                   3'-ACAUGUAAUGGUAUAUUACAUUUUUCU-5'    (SEQ ID NO: 4653)
LDHA-1763 Target:  5'-TGTACATTACCATATAATGTAAAAAGA-3'    (SEQ ID NO: 6667)

5'-ACAUUACCAUAUAAUGUAAAAAGat-3'      (SEQ ID NO: 2640)
                   3'-CAUGUAAUGGUAUAUUACAUUUUUCUA-5'    (SEQ ID NO: 4654)
LDHA-1764 Target:  5'-GTACATTACCATATAATGTAAAAAGAT-3'    (SEQ ID NO: 6668)

5'-CAUUACCAUAUAAUGUAAAAAGAtc-3'      (SEQ ID NO: 2641)
                   3'-AUGUAAUGGUAUAUUACAUUUUUCUAG-5'    (SEQ ID NO: 4655)
LDHA-1765 Target:  5'-TACATTACCATATAATGTAAAAAGATC-3'    (SEQ ID NO: 6669)

5'-AUUACCAUAUAAUGUAAAAAGAUct-3'      (SEQ ID NO: 2642)
                   3'-UGUAAUGGUAUAUUACAUUUUUCUAGA-5'    (SEQ ID NO: 4656)
LDHA-1766 Target:  5'-ACATTACCATATAATGTAAAAAGATCT-3'    (SEQ ID NO: 6670)

5'-UUACCAUAUAAUGUAAAAAGAUCta-3'      (SEQ ID NO: 2643)
                   3'-GUAAUGGUAUAUUACAUUUUUCUAGAU-5'    (SEQ ID NO: 4657)
LDHA-1767 Target:  5'-CATTACCATATAATGTAAAAAGATCTA-3'    (SEQ ID NO: 6671)

5'-UACCAUAUAAUGUAAAAAGAUCUac-3'      (SEQ ID NO: 2644)
                   3'-UAAUGGUAUAUUACAUUUUUCUAGAUG-5'    (SEQ ID NO: 4658)
LDHA-1768 Target:  5'-ATTACCATATAATGTAAAAAGATCTAC-3'    (SEQ ID NO: 6672)

5'-ACCAUAUAAUGUAAAAAGAUCUACa-3'      (SEQ ID NO: 2645)
                   3'-AAUGGUAUAUUACAUUUUUCUAGAUGU-5'    (SEQ ID NO: 4659)
LDHA-1769 Target:  5'-TTACCATATAATGTAAAAAGATCTACA-3'    (SEQ ID NO: 6673)

5'-CCAUAUAAUGUAAAAAGAUCUACat-3'      (SEQ ID NO: 2646)
                   3'-AUGGUAUAUUACAUUUUUCUAGAUGUA-5'    (SEQ ID NO: 4660)
LDHA-1770 Target:  5'-TACCATATAATGTAAAAAGATCTACAT-3'    (SEQ ID NO: 6674)

5'-CAUAUAAUGUAAAAAGAUCUACAta-3'      (SEQ ID NO: 2647)
                   3'-UGGUAUAUUACAUUUUUCUAGAUGUAU-5'    (SEQ ID NO: 4661)
LDHA-1771 Target:  5'-ACCATATAATGTAAAAAGATCTACATA-3'    (SEQ ID NO: 6675)

5'-AUAUAAUGUAAAAAGAUCUACAUac-3'      (SEQ ID NO: 2648)
                   3'-GGUAUAUUACAUUUUUCUAGAUGUAUG-5'    (SEQ ID NO: 4662)
LDHA-1772 Target:  5'-CCATATAATGTAAAAAGATCTACATAC-3'    (SEQ ID NO: 6676)

5'-UAUAAUGUAAAAAGAUCUACAUAca-3'      (SEQ ID NO: 2649)
                   3'-GUAUAUUACAUUUUUCUAGAUGUAUGU-5'    (SEQ ID NO: 4663)
LDHA-1773 Target:  5'-CATATAATGTAAAAAGATCTACATACA-3'    (SEQ ID NO: 6677)

5'-AUAAUGUAAAAAGAUCUACAUACaa-3'      (SEQ ID NO: 2650)
                   3'-UAUAUUACAUUUUUCUAGAUGUAUGUU-5'    (SEQ ID NO: 4664)
LDHA-1774 Target:  5'-ATATAATGTAAAAAGATCTACATACAA-3'    (SEQ ID NO: 6678)

5'-UAAUGUAAAAAGAUCUACAUACAaa-3'      (SEQ ID NO: 2651)
                   3'-AUAUUACAUUUUUCUAGAUGUAUGUUU-5'    (SEQ ID NO: 4665)
LDHA-1775 Target:  5'-TATAATGTAAAAAGATCTACATACAAA-3'    (SEQ ID NO: 6679)

5'-AAUGUAAAAAGAUCUACAUACAAac-3'      (SEQ ID NO: 2652)
                   3'-UAUUACAUUUUUCUAGAUGUAUGUUUG-5'    (SEQ ID NO: 4666)
LDHA-1776 Target:  5'-ATAATGTAAAAAGATCTACATACAAAC-3'    (SEQ ID NO: 6680)

5'-AUGUAAAAAGAUCUACAUACAAAca-3'      (SEQ ID NO: 2653)
                   3'-AUUACAUUUUUCUAGAUGUAUGUUUGU-5'    (SEQ ID NO: 4667)
LDHA-1777 Target:  5'-TAATGTAAAAAGATCTACATACAAACA-3'    (SEQ ID NO: 6681)

5'-UGUAAAAAGAUCUACAUACAAACaa-3'      (SEQ ID NO: 2654)
                   3'-UUACAUUUUUCUAGAUGUAUGUUUGUU-5'    (SEQ ID NO: 4668)
LDHA-1778 Target:  5'-AATGTAAAAAGATCTACATACAAACAA-3'    (SEQ ID NO: 6682)

5'-GUAAAAAGAUCUACAUACAAACAat-3'      (SEQ ID NO: 2655)
                   3'-UACAUUUUUCUAGAUGUAUGUUUGUUA-5'    (SEQ ID NO: 4669)
LDHA-1779 Target:  5'-ATGTAAAAAGATCTACATACAAACAAT-3'    (SEQ ID NO: 6683)

5'-UAAAAAGAUCUACAUACAAACAAtg-3'      (SEQ ID NO: 2656)
                   3'-ACAUUUUUCUAGAUGUAUGUUUGUUAC-5'    (SEQ ID NO: 4670)
LDHA-1780 Target:  5'-TGTAAAAAGATCTACATACAAACAATG-3'    (SEQ ID NO: 6684)

5'-AAAAAGAUCUACAUACAAACAAUgc-3'      (SEQ ID NO: 2657)
                   3'-CAUUUUUCUAGAUGUAUGUUUGUUACG-5'    (SEQ ID NO: 4671)
LDHA-1781 Target:  5'-GTAAAAAGATCTACATACAAACAATGC-3'    (SEQ ID NO: 6685)
```

TABLE 12-continued

Additional Selected Human Anti-Lactate Dehydrogenase DsiRNA Agents (Asymmetrics)

| | | |
|---|---|---|
| | 5'-A<u>AA</u>AGAUCUACAUA<u>AC</u>AAACAAUGca-3' | (SEQ ID NO: 2658) |
| | 3'-<u>AUUU</u>UUCUAGAUGUAU<u>GU</u>UUGUUA<u>CGU</u>-5' | (SEQ ID NO: 4672) |
| LDHA-1782 Target: | 5'-TAAAAAGATCTACATACAAACAATGCA-3' | (SEQ ID NO: 6686) |
| | 5'-A<u>AA</u>GAUCUACAUA<u>C</u>AAACAAUGCaa-3' | (SEQ ID NO: 2659) |
| | 3'-<u>UUUUU</u>CUAGAUGUAU<u>GU</u>UUGUUA<u>CGU</u>U-5' | (SEQ ID NO: 4673) |
| LDHA-1783 Target: | 5'-AAAAAGATCTACATACAAACAATGCAA-3' | (SEQ ID NO: 6687) |
| | 5'-A<u>A</u>GAUCUACAUAC<u>AA</u>ACAAUGCAac-3' | (SEQ ID NO: 2660) |
| | 3'-<u>UUUU</u>CUAGAUGUAUG<u>UU</u>UGUUACG<u>UUG</u>-5' | (SEQ ID NO: 4674) |
| LDHA-1784 Target: | 5'-AAAAGATCTACATACAAACAATGCAAC-3' | (SEQ ID NO: 6688) |
| | 5'-A<u>G</u>AUCUACAUACA<u>AA</u>CAAUGCAcc-3' | (SEQ ID NO: 2661) |
| | 3'-<u>UUU</u>CUAGAUGUAUG<u>UU</u>UGUUACG<u>UUGG</u>-5' | (SEQ ID NO: 4675) |
| LDHA-1785 Target: | 5'-AAAGATCTACATACAAACAATGCAACC-3' | (SEQ ID NO: 6689) |
| | 5'-G<u>A</u>UCUACAUACAA<u>AC</u>AAUGCAACca-3' | (SEQ ID NO: 2662) |
| | 3'-<u>UUC</u>UAGAUGUAUGU<u>UU</u>GUUACGUU<u>GGU</u>-5' | (SEQ ID NO: 4676) |
| LDHA-1786 Target: | 5'-AAGATCTACATACAAACAATGCAACCA-3' | (SEQ ID NO: 6690) |
| | 5'-A<u>U</u>CUACAUACAAA<u>C</u>AAUGCAACCaa-3' | (SEQ ID NO: 2663) |
| | 3'-<u>UC</u>UAGAUGUAUGUU<u>U</u>GUUACGUUG<u>GUU</u>-5' | (SEQ ID NO: 4677) |
| LDHA-1787 Target: | 5'-AGATCTACATACAAACAATGCAACCAA-3' | (SEQ ID NO: 6691) |
| | 5'-U<u>C</u>UACAUACAAAC<u>A</u>AUGCAACCAac-3' | (SEQ ID NO: 2664) |
| | 3'-<u>C</u>UAGAUGUAUGUUU<u>G</u>UUACGUUGG<u>UUG</u>-5' | (SEQ ID NO: 4678) |
| LDHA-1788 Target: | 5'-GATCTACATACAAACAATGCAACCAAC-3' | (SEQ ID NO: 6692) |
| | 5'-C<u>U</u>ACAUACAAACA<u>AU</u>GCAACCAAct-3' | (SEQ ID NO: 2665) |
| | 3'-<u>UA</u>GAUGUAUGUUUG<u>UU</u>ACGUUGGU<u>UGA</u>-5' | (SEQ ID NO: 4679) |
| LDHA-1789 Target: | 5'-ATCTACATACAAACAATGCAACCAACT-3' | (SEQ ID NO: 6693) |
| | 5'-U<u>A</u>CAUACAAACAAUG<u>C</u>AACCAACta-3' | (SEQ ID NO: 2666) |
| | 3'-<u>AG</u>AUGUAUGUUUGUU<u>AC</u>GUUGGU<u>UGAU</u>-5' | (SEQ ID NO: 4680) |
| LDHA-1790 Target: | 5'-TCTACATACAAACAATGCAACCAACTA-3' | (SEQ ID NO: 6694) |
| | 5'-A<u>C</u>AUACAAACAAUGC<u>A</u>ACCAACUat-3' | (SEQ ID NO: 2667) |
| | 3'-<u>GA</u>UGUAUGUUUGUUA<u>C</u>GUUGGUU<u>GAUA</u>-5' | (SEQ ID NO: 4681) |
| LDHA-1791 Target: | 5'-CTACATACAAACAATGCAACCAACTAT-3' | (SEQ ID NO: 6695) |
| | 5'-C<u>A</u>UACAAACAAUGC<u>A</u>ACCAACUAtc-3' | (SEQ ID NO: 2668) |
| | 3'-<u>AU</u>GUAUGUUUGUUAC<u>G</u>UUGGUUG<u>AUAG</u>-5' | (SEQ ID NO: 4682) |
| LDHA-1792 Target: | 5'-TACATACAAACAATGCAACCAACTATC-3' | (SEQ ID NO: 6696) |
| | 5'-A<u>U</u>ACAAACAAUGCA<u>AC</u>CAACUAUcc-3' | (SEQ ID NO: 2669) |
| | 3'-<u>UG</u>UAUGUUUGUUACG<u>UU</u>GGUUGA<u>UAGG</u>-5' | (SEQ ID NO: 4683) |
| LDHA-1793 Target: | 5'-ACATACAAACAATGCAACCAACTATCC-3' | (SEQ ID NO: 6697) |
| | 5'-U<u>A</u>CAAACAAUGCA<u>AC</u>CAACUAUCca-3' | (SEQ ID NO: 2670) |
| | 3'-<u>GU</u>AUGUUUGUUACG<u>UU</u>GGUUGAU<u>AGGU</u>-5' | (SEQ ID NO: 4684) |
| LDHA-1794 Target: | 5'-CATACAAACAATGCAACCAACTATCCA-3' | (SEQ ID NO: 6698) |
| | 5'-A<u>C</u>AAACAAUGCAAC<u>C</u>AACUAUCCaa-3' | (SEQ ID NO: 2671) |
| | 3'-<u>UA</u>UGUUUGUUACGU<u>UG</u>GUUGAUA<u>GGUU</u>-5' | (SEQ ID NO: 4685) |
| LDHA-1795 Target: | 5'-ATACAAACAATGCAACCAACTATCCAA-3' | (SEQ ID NO: 6699) |
| | 5'-C<u>AA</u>ACAAUGCAACC<u>A</u>ACUAUCCAag-3' | (SEQ ID NO: 2672) |
| | 3'-<u>AU</u>GUUUGUUACGUU<u>GG</u>UUGAUAG<u>GUUC</u>-5' | (SEQ ID NO: 4686) |
| LDHA-1796 Target: | 5'-TACAAACAATGCAACCAACTATCCAAG-3' | (SEQ ID NO: 6700) |
| | 5'-A<u>AA</u>CAAUGCAACCA<u>AC</u>UAUCCAAgt-3' | (SEQ ID NO: 2673) |
| | 3'-<u>UG</u>UUUGUUACGUUG<u>G</u>UUGAUAGG<u>UUCA</u>-5' | (SEQ ID NO: 4687) |
| LDHA-1797 Target: | 5'-ACAAACAATGCAACCAACTATCCAAGT-3' | (SEQ ID NO: 6701) |
| | 5'-A<u>A</u>CAAUGCAACCA<u>AC</u>UAUCCAAGtg-3' | (SEQ ID NO: 2674) |
| | 3'-<u>GU</u>UUGUUACGUUGG<u>UU</u>GAUAGGUU<u>CAC</u>-5' | (SEQ ID NO: 4688) |
| LDHA-1798 Target: | 5'-CAAACAATGCAACCAACTATCCAAGTG-3' | (SEQ ID NO: 6702) |
| | 5'-A<u>C</u>AAUGCAACCAAC<u>U</u>AUCCAAGUgt-3' | (SEQ ID NO: 2675) |
| | 3'-<u>UUU</u>GUUACGUUGGU<u>UG</u>AUAGGUU<u>CACA</u>-5' | (SEQ ID NO: 4689) |
| LDHA-1799 Target: | 5'-AAACAATGCAACCAACTATCCAAGTGT-3' | (SEQ ID NO: 6703) |
| | 5'-C<u>AA</u>UGCAACCAACU<u>AU</u>CCAAGUGtt-3' | (SEQ ID NO: 2676) |
| | 3'-<u>UU</u>GUUACGUUGGUU<u>GA</u>UAGGUUC<u>ACAA</u>-5' | (SEQ ID NO: 4690) |
| LDHA-1800 Target: | 5'-AACAATGCAACCAACTATCCAAGTGTT-3' | (SEQ ID NO: 6704) |

TABLE 12-continued

Additional Selected Human Anti-Lactate Dehydrogenase DsiRNA Agents (Asymmetrics)

|  |  |  |
|---|---|---|
| LDHA-1801 Target: | 5'-AAUGCAACCAACUAUCCAAGUGUta-3'<br>3'-UGUUACGUUGGUUGAUAGGUUCACAAU-5'<br>5'-ACAATGCAACCAACTATCCAAGTGTTA-3' | (SEQ ID NO: 2677)<br>(SEQ ID NO: 4691)<br>(SEQ ID NO: 6705) |
| LDHA-1802 Target: | 5'-AUGCAACCAACUAUCCAAGUGUUat-3'<br>3'-GUUACGUUGGUUGAUAGGUUCACAAUA-5'<br>5'-CAATGCAACCAACTATCCAAGTGTTAT-3' | (SEQ ID NO: 2678)<br>(SEQ ID NO: 4692)<br>(SEQ ID NO: 6706) |
| LDHA-1803 Target: | 5'-UGCAACCAACUAUCCAAGUGUUAta-3'<br>3'-UUACGUUGGUUGAUAGGUUCACAAUAU-5'<br>5'-AATGCAACCAACTATCCAAGTGTTATA-3' | (SEQ ID NO: 2679)<br>(SEQ ID NO: 4693)<br>(SEQ ID NO: 6707) |
| LDHA-1804 Target: | 5'-GCAACCAACUAUCCAAGUGUUAUac-3'<br>3'-UACGUUGGUUGAUAGGUUCACAAUAUG-5'<br>5'-ATGCAACCAACTATCCAAGTGTTATAC-3' | (SEQ ID NO: 2680)<br>(SEQ ID NO: 4694)<br>(SEQ ID NO: 6708) |
| LDHA-1809 Target: | 5'-CAACUAUCCAAGUGUUAUACCAAct-3'<br>3'-UGGUUGAUAGGUUCACAAUAUGGUUGA-5'<br>5'-ACCAACTATCCAAGTGTTATACCAACT-3' | (SEQ ID NO: 2681)<br>(SEQ ID NO: 4695)<br>(SEQ ID NO: 6709) |
| LDHA-1810 Target: | 5'-AACUAUCCAAGUGUUAUACCAACta-3'<br>3'-GGUUGAUAGGUUCACAAUAUGGUUGAU-5'<br>5'-CCAACTATCCAAGTGTTATACCAACTA-3' | (SEQ ID NO: 2682)<br>(SEQ ID NO: 4696)<br>(SEQ ID NO: 6710) |
| LDHA-1813 Target: | 5'-UAUCCAAGUGUUAUACCAACUAAaa-3'<br>3'-UGAUAGGUUCACAAUAUGGUUGAUUUU-5'<br>5'-ACTATCCAAGTGTTATACCAACTAAAA-3' | (SEQ ID NO: 2683)<br>(SEQ ID NO: 4697)<br>(SEQ ID NO: 6711) |
| LDHA-1814 Target: | 5'-AUCCAAGUGUUAUACCAACUAAAac-3'<br>3'-GAUAGGUUCACAAUAUGGUUGAUUUUG-5'<br>5'-CTATCCAAGTGTTATACCAACTAAAAC-3' | (SEQ ID NO: 2684)<br>(SEQ ID NO: 4698)<br>(SEQ ID NO: 6712) |
| LDHA-1817 Target: | 5'-CAAGUGUUAUACCAACUAAAACCcc-3'<br>3'-AGGUUCACAAUAUGGUUGAUUUUGGGG-5'<br>5'-TCCAAGTGTTATACCAACTAAAACCCC-3' | (SEQ ID NO: 2685)<br>(SEQ ID NO: 4699)<br>(SEQ ID NO: 6713) |
| LDHA-1818 Target: | 5'-AAGUGUUAUACCAACUAAAACCCcc-3'<br>3'-GGUUCACAAUAUGGUUGAUUUUGGGGG-5'<br>5'-CCAAGTGTTATACCAACTAAAACCCCC-3' | (SEQ ID NO: 2686)<br>(SEQ ID NO: 4700)<br>(SEQ ID NO: 6714) |
| LDHA-1819 Target: | 5'-AGUGUUAUACCAACUAAAACCCCca-3'<br>3'-GUUCACAAUAUGGUUGAUUUUGGGGGU-5'<br>5'-CAAGTGTTATACCAACTAAAACCCCCA-3' | (SEQ ID NO: 2687)<br>(SEQ ID NO: 4701)<br>(SEQ ID NO: 6715) |
| LDHA-1820 Target: | 5'-GUGUUAUACCAACUAAAACCCCCaa-3'<br>3'-UUCACAAUAUGGUUGAUUUUGGGGGUU-5'<br>5'-AAGTGTTATACCAACTAAAACCCCCAA-3' | (SEQ ID NO: 2688)<br>(SEQ ID NO: 4702)<br>(SEQ ID NO: 6716) |
| LDHA-1821 Target: | 5'-UGUUAUACCAACUAAAACCCCCAat-3'<br>3'-UCACAAUAUGGUUGAUUUUGGGGGUUA-5'<br>5'-AGTGTTATACCAACTAAAACCCCCAAT-3' | (SEQ ID NO: 2689)<br>(SEQ ID NO: 4703)<br>(SEQ ID NO: 6717) |
| LDHA-1822 Target: | 5'-GUUAUACCAACUAAAACCCCCAAta-3'<br>3'-CACAAUAUGGUUGAUUUUGGGGGUUAU-5'<br>5'-GTGTTATACCAACTAAAACCCCCAATA-3' | (SEQ ID NO: 2690)<br>(SEQ ID NO: 4704)<br>(SEQ ID NO: 6718) |
| LDHA-1823 Target: | 5'-UUAUACCAACUAAAACCCCCAAUaa-3'<br>3'-ACAAUAUGGUUGAUUUUGGGGGUUAUU-5'<br>5'-TGTTATACCAACTAAAACCCCCAATAA-3' | (SEQ ID NO: 2691)<br>(SEQ ID NO: 4705)<br>(SEQ ID NO: 6719) |
| LDHA-1824 Target: | 5'-UAUACCAACUAAAACCCCCAAUAaa-3'<br>3'-CAAUAUGGUUGAUUUUGGGGGUUAUUU-5'<br>5'-GTTATACCAACTAAAACCCCCAATAAA-3' | (SEQ ID NO: 2692)<br>(SEQ ID NO: 4706)<br>(SEQ ID NO: 6720) |
| LDHA-1825 Target: | 5'-AUACCAACUAAAACCCCCAAUAAac-3'<br>3'-AAUAUGGUUGAUUUUGGGGGUUAUUUG-5'<br>5'-TTATACCAACTAAAACCCCCAATAAAC-3' | (SEQ ID NO: 2693)<br>(SEQ ID NO: 4707)<br>(SEQ ID NO: 6721) |
| LDHA-1826 Target: | 5'-UACCAACUAAAACCCCCAAUAAAcc-3'<br>3'-AUAUGGUUGAUUUUGGGGGUUAUUUGG-5'<br>5'-TATACCAACTAAAACCCCCAATAAACC-3' | (SEQ ID NO: 2694)<br>(SEQ ID NO: 4708)<br>(SEQ ID NO: 6722) |
| LDHA-1827 Target: | 5'-ACCAACUAAAACCCCCAAUAAACct-3'<br>3'-UAUGGUUGAUUUUGGGGGUUAUUUGGA-5'<br>5'-ATACCAACTAAAACCCCCAATAAACCT-3' | (SEQ ID NO: 2695)<br>(SEQ ID NO: 4709)<br>(SEQ ID NO: 6723) |

TABLE 12-continued

Additional Selected Human Anti-Lactate Dehydrogenase DsiRNA
Agents (Asymmetrics)

|  |  |  |
|---|---|---|
| LDHA-1828 Target: | 5'-CCAACUAAAACCCCCAAUAAACCtt-3'<br>3'-AUGGUUGAUUUUGGGGGUUAUUUGGAA-5'<br>5'-TACCAACTAAAACCCCCAATAAACCTT-3' | (SEQ ID NO: 2696)<br>(SEQ ID NO: 4710)<br>(SEQ ID NO: 6724) |
| LDHA-1829 Target: | 5'-CAACUAAAACCCCCAAUAAACCUtg-3'<br>3'-UGGUUGAUUUUGGGGGUUAUUUGGAAC-5'<br>5'-ACCAACTAAAACCCCCAATAAACCTTG-3' | (SEQ ID NO: 2697)<br>(SEQ ID NO: 4711)<br>(SEQ ID NO: 6725) |
| LDHA-1830 Target: | 5'-AACUAAAACCCCCAAUAAACCUUga-3'<br>3'-GGUUGAUUUUGGGGGUUAUUUGGAACU-5'<br>5'-CCAACTAAAACCCCCAATAAACCTTGA-3' | (SEQ ID NO: 2698)<br>(SEQ ID NO: 4712)<br>(SEQ ID NO: 6726) |
| LDHA-1831 Target: | 5'-ACUAAAACCCCCAAUAAACCUUGaa-3'<br>3'-GUUGAUUUUGGGGGUUAUUUGGAACUU-5'<br>5'-CAACTAAAACCCCCAATAAACCTTGAA-3' | (SEQ ID NO: 2699)<br>(SEQ ID NO: 4713)<br>(SEQ ID NO: 6727) |
| LDHA-1832 Target: | 5'-CUAAAACCCCCAAUAAACCUUGAac-3'<br>3'-UUGAUUUUGGGGGUUAUUUGGAACUUG-5'<br>5'-AACTAAAACCCCCAATAAACCTTGAAC-3' | (SEQ ID NO: 2700)<br>(SEQ ID NO: 4714)<br>(SEQ ID NO: 6728) |
| LDHA-1833 Target: | 5'-UAAAACCCCCAAUAAACCUUGAAca-3'<br>3'-UGAUUUUGGGGGUUAUUUGGAACUUGU-5'<br>5'-ACTAAAACCCCCAATAAACCTTGAACA-3' | (SEQ ID NO: 2701)<br>(SEQ ID NO: 4715)<br>(SEQ ID NO: 6729) |
| LDHA-1834 Target: | 5'-AAAACCCCCAAUAAACCUUGAACag-3'<br>3'-GAUUUUGGGGGUUAUUUGGAACUUGUC-5'<br>5'-CTAAAACCCCCAATAAACCTTGAACAG-3' | (SEQ ID NO: 2702)<br>(SEQ ID NO: 4716)<br>(SEQ ID NO: 6730) |
| LDHA-1835 Target: | 5'-AAACCCCCAAUAAACCUUGAACAgt-3'<br>3'-AUUUUGGGGGUUAUUUGGAACUUGUCA-5'<br>5'-TAAAACCCCCAATAAACCTTGAACAGT-3' | (SEQ ID NO: 2703)<br>(SEQ ID NO: 4717)<br>(SEQ ID NO: 6731) |
| LDHA-1836 Target: | 5'-AACCCCCAAUAAACCUUGAACAGtg-3'<br>3'-UUUUGGGGGUUAUUUGGAACUUGUCAC-5'<br>5'-AAAACCCCCAATAAACCTTGAACAGTG-3' | (SEQ ID NO: 2704)<br>(SEQ ID NO: 4718)<br>(SEQ ID NO: 6732) |
| LDHA-1837 Target: | 5'-ACCCCCAAUAAACCUUGAACAGUga-3'<br>3'-UUUGGGGGUUAUUUGGAACUUGUCACU-5'<br>5'-AAACCCCCAATAAACCTTGAACAGTGA-3' | (SEQ ID NO: 2705)<br>(SEQ ID NO: 4719)<br>(SEQ ID NO: 6733) |
| LDHA-1838 Target: | 5'-CCCCCAAUAAACCUUGAACAGUGac-3'<br>3'-UUGGGGGUUAUUUGGAACUUGUCACUG-5'<br>5'-AACCCCCAATAAACCTTGAACAGTGAC-3' | (SEQ ID NO: 2706)<br>(SEQ ID NO: 4720)<br>(SEQ ID NO: 6734) |
| LDHA-1839 Target: | 5'-CCCCAAUAAACCUUGAACAGUGAct-3'<br>3'-UGGGGGUUAUUUGGAACUUGUCACUGA-5'<br>5'-ACCCCCAATAAACCTTGAACAGTGACT-3' | (SEQ ID NO: 2707)<br>(SEQ ID NO: 4721)<br>(SEQ ID NO: 6735) |
| LDHA-1840 Target: | 5'-CCCAAUAAACCUUGAACAGUGACta-3'<br>3'-GGGGGUUAUUUGGAACUUGUCACUGAU-5'<br>5'-CCCCCAATAAACCTTGAACAGTGACTA-3' | (SEQ ID NO: 2708)<br>(SEQ ID NO: 4722)<br>(SEQ ID NO: 6736) |
| LDHA-1841 Target: | 5'-CCAAUAAACCUUGAACAGUGACUac-3'<br>3'-GGGGUUAUUUGGAACUUGUCACUGAUG-5'<br>5'-CCCCAATAAACCTTGAACAGTGACTAC-3' | (SEQ ID NO: 2709)<br>(SEQ ID NO: 4723)<br>(SEQ ID NO: 6737) |
| LDHA-1842 Target: | 5'-CAAUAAACCUUGAACAGUGACUAct-3'<br>3'-GGGUUAUUUGGAACUUGUCACUGAUGA-5'<br>5'-CCCAATAAACCTTGAACAGTGACTACT-3' | (SEQ ID NO: 2710)<br>(SEQ ID NO: 4724)<br>(SEQ ID NO: 6738) |
| LDHA-1843 Target: | 5'-AAUAAACCUUGAACAGUGACUACtt-3'<br>3'-GGUUAUUUGGAACUUGUCACUGAUGAA-5'<br>5'-CCAATAAACCTTGAACAGTGACTACTT-3' | (SEQ ID NO: 2711)<br>(SEQ ID NO: 4725)<br>(SEQ ID NO: 6739) |
| LDHA-1844 Target: | 5'-AUAAACCUUGAACAGUGACUACUtt-3'<br>3'-GUUAUUUGGAACUUGUCACUGAUGAAA-5'<br>5'-CAATAAACCTTGAACAGTGACTACTTT-3' | (SEQ ID NO: 2712)<br>(SEQ ID NO: 4726)<br>(SEQ ID NO: 6740) |
| LDHA-1845 Target: | 5'-UAAACCUUGAACAGUGACUACUUtg-3'<br>3'-UUAUUUGGAACUUGUCACUGAUGAAAC-5'<br>5'-AATAAACCTTGAACAGTGACTACTTTG-3' | (SEQ ID NO: 2713)<br>(SEQ ID NO: 4727)<br>(SEQ ID NO: 6741) |
| LDHA-1846 Target: | 5'-AAACCUUGAACAGUGACUACUUUgg-3'<br>3'-UAUUUGGAACUUGUCACUGAUGAAACC-5'<br>5'-ATAAACCTTGAACAGTGACTACTTTGG-3' | (SEQ ID NO: 2714)<br>(SEQ ID NO: 4728)<br>(SEQ ID NO: 6742) |

TABLE 12-continued

Additional Selected Human Anti-Lactate Dehydrogenase DsiRNA Agents (Asymmetrics)

```
                5'-AACCUUGAACAGUGACUACUUUGgt-3'      (SEQ ID NO: 2715)
                3'-AUUUGGAACUUGUCACUGAUGAAACCA-5'    (SEQ ID NO: 4729)
LDHA-1847 Target: 5'-TAAACCTTGAACAGTGACTACTTTGGT-3'  (SEQ ID NO: 6743)

5'-ACCUUGAACAGUGACUACUUUGGtt-3'      (SEQ ID NO: 2716)
                3'-UUUGGAACUUGUCACUGAUGAAACCAA-5'    (SEQ ID NO: 4730)
LDHA-1848 Target: 5'-AAACCTTGAACAGTGACTACTTTGGTT-3'  (SEQ ID NO: 6744)

5'-CCUUGAACAGUGACUACUUUGGUta-3'      (SEQ ID NO: 2717)
                3'-UUGGAACUUGUCACUGAUGAAACCAAU-5'    (SEQ ID NO: 4731)
LDHA-1849 Target: 5'-AACCTTGAACAGTGACTACTTTGGTTA-3'  (SEQ ID NO: 6745)

5'-CUUGAACAGUGACUACUUUGGUUaa-3'      (SEQ ID NO: 2718)
                3'-UGGAACUUGUCACUGAUGAAACCAAUU-5'    (SEQ ID NO: 4732)
LDHA-1850 Target: 5'-ACCTTGAACAGTGACTACTTTGGTTAA-3'  (SEQ ID NO: 6746)

5'-UUGAACAGUGACUACUUUGGUUAat-3'      (SEQ ID NO: 2719)
                3'-GGAACUUGUCACUGAUGAAACCAAUUA-5'    (SEQ ID NO: 4733)
LDHA-1851 Target: 5'-CCTTGAACAGTGACTACTTTGGTTAAT-3'  (SEQ ID NO: 6747)

5'-UGAACAGUGACUACUUUGGUUAAtt-3'      (SEQ ID NO: 2720)
                3'-GAACUUGUCACUGAUGAAACCAAUUAA-5'    (SEQ ID NO: 4734)
LDHA-1852 Target: 5'-CTTGAACAGTGACTACTTTGGTTAATT-3'  (SEQ ID NO: 6748)

5'-GAACAGUGACUACUUUGGUUAAUtc-3'      (SEQ ID NO: 2721)
                3'-AACUUGUCACUGAUGAAACCAAUUAAG-5'    (SEQ ID NO: 4735)
LDHA-1853 Target: 5'-TTGAACAGTGACTACTTTGGTTAATTC-3'  (SEQ ID NO: 6749)

5'-AACAGUGACUACUUUGGUUAAUUca-3'      (SEQ ID NO: 2722)
                3'-ACUUGUCACUGAUGAAACCAAUUAAGU-5'    (SEQ ID NO: 4736)
LDHA-1854 Target: 5'-TGAACAGTGACTACTTTGGTTAATTCA-3'  (SEQ ID NO: 6750)

5'-ACAGUGACUACUUUGGUUAAUUCat-3'      (SEQ ID NO: 2723)
                3'-CUUGUCACUGAUGAAACCAAUUAAGUA-5'    (SEQ ID NO: 4737)
LDHA-1855 Target: 5'-GAACAGTGACTACTTTGGTTAATTCAT-3'  (SEQ ID NO: 6751)

5'-CAGUGACUACUUUGGUUAAUUCAtt-3'      (SEQ ID NO: 2724)
                3'-UUGUCACUGAUGAAACCAAUUAAGUAA-5'    (SEQ ID NO: 4738)
LDHA-1856 Target: 5'-AACAGTGACTACTTTGGTTAATTCATT-3'  (SEQ ID NO: 6752)

5'-AGUGACUACUUUGGUUAAUUCAUta-3'      (SEQ ID NO: 2725)
                3'-UGUCACUGAUGAAACCAAUUAAGUAAU-5'    (SEQ ID NO: 4739)
LDHA-1857 Target: 5'-ACAGTGACTACTTTGGTTAATTCATTA-3'  (SEQ ID NO: 6753)

5'-GUGACUACUUUGGUUAAUUCAUUat-3'      (SEQ ID NO: 2726)
                3'-GUCACUGAUGAAACCAAUUAAGUAAUA-5'    (SEQ ID NO: 4740)
LDHA-1858 Target: 5'-CAGTGACTACTTTGGTTAATTCATTAT-3'  (SEQ ID NO: 6754)

5'-UGACUACUUUGGUUAAUUCAUUAta-3'      (SEQ ID NO: 2727)
                3'-UCACUGAUGAAACCAAUUAAGUAAUAU-5'    (SEQ ID NO: 4741)
LDHA-1859 Target: 5'-AGTGACTACTTTGGTTAATTCATTATA-3'  (SEQ ID NO: 6755)

5'-GACUACUUUGGUUAAUUCAUUAUat-3'      (SEQ ID NO: 2728)
                3'-CACUGAUGAAACCAAUUAAGUAAUAUA-5'    (SEQ ID NO: 4742)
LDHA-1860 Target: 5'-GTGACTACTTTGGTTAATTCATTATAT-3'  (SEQ ID NO: 6756)

5'-ACUACUUUGGUUAAUUCAUUAUAtt-3'      (SEQ ID NO: 2729)
                3'-ACUGAUGAAACCAAUUAAGUAAUAUAA-5'    (SEQ ID NO: 4743)
LDHA-1861 Target: 5'-TGACTACTTTGGTTAATTCATTATATT-3'  (SEQ ID NO: 6757)

5'-CUACUUUGGUUAAUUCAUUAUAUta-3'      (SEQ ID NO: 2730)
                3'-CUGAUGAAACCAAUUAAGUAAUAUAAU-5'    (SEQ ID NO: 4744)
LDHA-1862 Target: 5'-GACTACTTTGGTTAATTCATTATATTA-3'  (SEQ ID NO: 6758)

5'-UACUUUGGUUAAUUCAUUAUAUUaa-3'      (SEQ ID NO: 2731)
                3'-UGAUGAAACCAAUUAAGUAAUAUAAUU-5'    (SEQ ID NO: 4745)
LDHA-1863 Target: 5'-ACTACTTTGGTTAATTCATTATATTAA-3'  (SEQ ID NO: 6759)

5'-ACUUUGGUUAAUUCAUUAUAUUAag-3'      (SEQ ID NO: 2732)
                3'-GAUGAAACCAAUUAAGUAAUAUAAUUC-5'    (SEQ ID NO: 4746)
LDHA-1864 Target: 5'-CTACTTTGGTTAATTCATTATATTAAG-3'  (SEQ ID NO: 6760)

5'-CUUUGGUUAAUUCAUUAUAUUAAga-3'      (SEQ ID NO: 2733)
                3'-AUGAAACCAAUUAAGUAAUAUAAUUCU-5'    (SEQ ID NO: 4747)
LDHA-1865 Target: 5'-TACTTTGGTTAATTCATTATATTAAGA-3'  (SEQ ID NO: 6761)
```

TABLE 12-continued

Additional Selected Human Anti-Lactate Dehydrogenase DsiRNA Agents (Asymmetrics)

|  |  |  |
| --- | --- | --- |
|  | 5'-UUUGGUUAAUUCAUUAUAUUAAGat-3' | (SEQ ID NO: 2734) |
|  | 3'-UGAAACCAAUUAAGUAAUAUAAUUCUA-5' | (SEQ ID NO: 4748) |
| LDHA-1866 Target: | 5'-ACTTTGGTTAATTCATTATATTAAGAT-3' | (SEQ ID NO: 6762) |
|  | 5'-UUGGUUAAUUCAUUAUAUUAAGAta-3' | (SEQ ID NO: 2735) |
|  | 3'-GAAACCAAUUAAGUAAUAUAAUUCUAU-5' | (SEQ ID NO: 4749) |
| LDHA-1867 Target: | 5'-CTTTGGTTAATTCATTATATTAAGATA-3' | (SEQ ID NO: 6763) |
|  | 5'-UGGUUAAUUCAUUAUAUUAAGAUat-3' | (SEQ ID NO: 2736) |
|  | 3'-AAACCAAUUAAGUAAUAUAAUUCUAUA-5' | (SEQ ID NO: 4750) |
| LDHA-1868 Target: | 5'-TTTGGTTAATTCATTATATTAAGATAT-3' | (SEQ ID NO: 6764) |
|  | 5'-GGUUAAUUCAUUAUAUUAAGAUAta-3' | (SEQ ID NO: 2737) |
|  | 3'-AACCAAUUAAGUAAUAUAAUUCUAUAU-5' | (SEQ ID NO: 4751) |
| LDHA-1869 Target: | 5'-TTGGTTAATTCATTATATTAAGATATA-3' | (SEQ ID NO: 6765) |
|  | 5'-GUUAAUUCAUUAUAUUAAGAUAUaa-3' | (SEQ ID NO: 2738) |
|  | 3'-ACCAAUUAAGUAAUAUAAUUCUAUAUU-5' | (SEQ ID NO: 4752) |
| LDHA-1870 Target: | 5'-TGGTTAATTCATTATATTAAGATATAA-3' | (SEQ ID NO: 6766) |
|  | 5'-UUAAUUCAUUAUAUUAAGAUAUAaa-3' | (SEQ ID NO: 2739) |
|  | 3'-CCAAUUAAGUAAUAUAAUUCUAUAUUU-5' | (SEQ ID NO: 4753) |
| LDHA-1871 Target: | 5'-GGTTAATTCATTATATTAAGATATAAA-3' | (SEQ ID NO: 6767) |
|  | 5'-UAAUUCAUUAUAUUAAGAUAUAAag-3' | (SEQ ID NO: 2740) |
|  | 3'-CAAUUAAGUAAUAUAAUUCUAUAUUUC-5' | (SEQ ID NO: 4754) |
| LDHA-1872 Target: | 5'-GTTAATTCATTATATTAAGATATAAAG-3' | (SEQ ID NO: 6768) |
|  | 5'-AAUUCAUUAUAUUAAGAUAUAAAgt-3' | (SEQ ID NO: 2741) |
|  | 3'-AAUUAAGUAAUAUAAUUCUAUAUUUCA-5' | (SEQ ID NO: 4755) |
| LDHA-1873 Target: | 5'-TTAATTCATTATATTAAGATATAAAGT-3' | (SEQ ID NO: 6769) |
|  | 5'-AUUCAUUAUAUUAAGAUAUAAAGtc-3' | (SEQ ID NO: 2742) |
|  | 3'-AUUAAGUAAUAUAAUUCUAUAUUUCAG-5' | (SEQ ID NO: 4756) |
| LDHA-1874 Target: | 5'-TAATTCATTATATTAAGATATAAAGTC-3' | (SEQ ID NO: 6770) |
|  | 5'-UUCAUUAUAUUAAGAUAUAAAGUca-3' | (SEQ ID NO: 2743) |
|  | 3'-UUAAGUAAUAUAAUUCUAUAUUUCAGU-5' | (SEQ ID NO: 4757) |
| LDHA-1875 Target: | 5'-AATTCATTATATTAAGATATAAAGTCA-3' | (SEQ ID NO: 6771) |
|  | 5'-UCAUUAUAUUAAGAUAUAAAGUCat-3' | (SEQ ID NO: 2744) |
|  | 3'-UAAGUAAUAUAAUUCUAUAUUUCAGUA-5' | (SEQ ID NO: 4758) |
| LDHA-1876 Target: | 5'-ATTCATTATATTAAGATATAAAGTCAT-3' | (SEQ ID NO: 6772) |
|  | 5'-CAUUAUAUUAAGAUAUAAAGUCAta-3' | (SEQ ID NO: 2745) |
|  | 3'-AAGUAAUAUAAUUCUAUAUUUCAGUAU-5' | (SEQ ID NO: 4759) |
| LDHA-1877 Target: | 5'-TTCATTATATTAAGATATAAAGTCATA-3' | (SEQ ID NO: 6773) |
|  | 5'-AUUAUAUUAAGAUAUAAAGUCAUaa-3' | (SEQ ID NO: 2746) |
|  | 3'-AGUAAUAUAAUUCUAUAUUUCAGUAUU-5' | (SEQ ID NO: 4760) |
| LDHA-1878 Target: | 5'-TCATTATATTAAGATATAAAGTCATAA-3' | (SEQ ID NO: 6774) |
|  | 5'-UUAUAUUAAGAUAUAAAGUCAUAaa-3' | (SEQ ID NO: 2747) |
|  | 3'-GUAAUAUAAUUCUAUAUUUCAGUAUUU-5' | (SEQ ID NO: 4761) |
| LDHA-1879 Target: | 5'-CATTATATTAAGATATAAAGTCATAAA-3' | (SEQ ID NO: 6775) |
|  | 5'-UAUAUUAAGAUAUAAAGUCAUAAag-3' | (SEQ ID NO: 2748) |
|  | 3'-UAAUAUAAUUCUAUAUUUCAGUAUUUC-5' | (SEQ ID NO: 4762) |
| LDHA-1880 Target: | 5'-ATTATATTAAGATATAAAGTCATAAAG-3' | (SEQ ID NO: 6776) |
|  | 5'-AUAUUAAGAUAUAAAGUCAUAAAgc-3' | (SEQ ID NO: 2749) |
|  | 3'-AAUAUAAUUCUAUAUUUCAGUAUUUCG-5' | (SEQ ID NO: 4763) |
| LDHA-1881 Target: | 5'-TTATATTAAGATATAAAGTCATAAAGC-3' | (SEQ ID NO: 6777) |
|  | 5'-UAUUAAGAUAUAAAGUCAUAAAGct-3' | (SEQ ID NO: 2750) |
|  | 3'-AUAUAAUUCUAUAUUUCAGUAUUUCGA-5' | (SEQ ID NO: 4764) |
| LDHA-1882 Target: | 5'-TATATTAAGATATAAAGTCATAAAGCT-3' | (SEQ ID NO: 6778) |
|  | 5'-AUUAAGAUAUAAAGUCAUAAAGCtg-3' | (SEQ ID NO: 2751) |
|  | 3'-UAUAAUUCUAUAUUUCAGUAUUUCGAC-5' | (SEQ ID NO: 4765) |
| LDHA-1883 Target: | 5'-ATATTAAGATATAAAGTCATAAAGCTG-3' | (SEQ ID NO: 6779) |
|  | 5'-UUAAGAUAUAAAGUCAUAAAGCUgc-3' | (SEQ ID NO: 2752) |
|  | 3'-AUAAUUCUAUAUUUCAGUAUUUCGACG-5' | (SEQ ID NO: 4766) |
| LDHA-1884 Target: | 5'-TATTAAGATATAAAGTCATAAAGCTGC-3' | (SEQ ID NO: 6780) |

TABLE 12-continued

Additional Selected Human Anti-Lactate Dehydrogenase DsiRNA Agents (Asymmetrics)

| | | |
|---|---|---|
| LDHA-1885 | 5'-UA<u>A</u>GAUAUAAAGUC<u>A</u>UAAAGCUGct-3'<br>3'-<u>UAAU</u>UCUAUAUUUC<u>A</u>GUAUUUCG<u>ACGA</u>-5'<br>Target: 5'-ATTAAGATATAAAGTCATAAAGCTGCT-3' | (SEQ ID NO: 2753)<br>(SEQ ID NO: 4767)<br>(SEQ ID NO: 6781) |
| LDHA-1886 | 5'-A<u>A</u>GAUAUAAAGUC<u>A</u>UAAAGCUGCta-3'<br>3'-<u>AAUU</u>CUAUAUUUC<u>A</u>GU<u>A</u>UUUCG<u>A</u>C<u>GAU</u>-5'<br>Target: 5'-TTAAGATATAAAGTCATAAAGCTGCTA-3' | (SEQ ID NO: 2754)<br>(SEQ ID NO: 4768)<br>(SEQ ID NO: 6782) |
| LDHA-1887 | 5'-<u>A</u>GAUAUAAAGUCAU<u>A</u>AAGCUGCUag-3'<br>3'-<u>AUUC</u>UAUAUUUCAG<u>U</u>AUUUCGAC<u>GAUC</u>-5'<br>Target: 5'-TAAGATATAAAGTCATAAAGCTGCTAG-3' | (SEQ ID NO: 2755)<br>(SEQ ID NO: 4769)<br>(SEQ ID NO: 6783) |
| LDHA-1888 | 5'-<u>G</u>AUAUAAAGUCAU<u>AAA</u>GCUGCUAgt-3'<br>3'-<u>UUC</u>U<u>A</u>UAUUUCAGUAU<u>U</u>UCGACG<u>AUCA</u>-5'<br>Target: 5'-AAGATATAAAGTCATAAAGCTGCTAGT-3' | (SEQ ID NO: 2756)<br>(SEQ ID NO: 4770)<br>(SEQ ID NO: 6784) |
| LDHA-1889 | 5'-<u>A</u>U<u>A</u>U<u>A</u>AAGUCAU<u>AAA</u>GCUGCUAGtt-3'<br>3'-<u>UC</u>U<u>A</u>UAUUUCAGU<u>A</u>U<u>UU</u>CGACGA<u>UCAA</u>-5'<br>Target: 5'-AGATATAAAGTCATAAAGCTGCTAGTT-3' | (SEQ ID NO: 2757)<br>(SEQ ID NO: 4771)<br>(SEQ ID NO: 6785) |
| LDHA-1890 | 5'-<u>U</u>A<u>U</u>A<u>A</u>AGUCAU<u>AAA</u>G<u>C</u>UGCUAGUta-3'<br>3'-<u>CU</u>AU<u>A</u>UUUCAGU<u>A</u>U<u>UU</u>CGACGA<u>UCAAU</u>-5'<br>Target: 5'-GATATAAAGTCATAAAGCTGCTAGTTA-3' | (SEQ ID NO: 2758)<br>(SEQ ID NO: 4772)<br>(SEQ ID NO: 6786) |
| LDHA-1891 | 5'-<u>A</u>U<u>AAA</u>GUCAU<u>AAA</u>G<u>C</u>UGCUAGUUat-3'<br>3'-<u>UAUAU</u>UUCAGUAU<u>UUC</u>GACGAUC<u>AAUA</u>-5'<br>Target: 5'-ATATAAAGTCATAAAGCTGCTAGTTAT-3' | (SEQ ID NO: 2759)<br>(SEQ ID NO: 4773)<br>(SEQ ID NO: 6787) |
| LDHA-1892 | 5'-<u>U</u>A<u>AA</u>GUCAU<u>AAA</u>GC<u>U</u>GCUAGUUAtt-3'<br>3'-<u>AUAU</u>UUCAGUAU<u>UUC</u>GACGAUC<u>AAUAA</u>-5'<br>Target: 5'-TATAAAGTCATAAAGCTGCTAGTTATT-3' | (SEQ ID NO: 2760)<br>(SEQ ID NO: 4774)<br>(SEQ ID NO: 6788) |
| LDHA-1893 | 5'-<u>AA</u>GUCAU<u>AAA</u>GCUGC<u>U</u>AGUUAUta-3'<br>3'-<u>UAUU</u>UCAGUAUUUC<u>G</u>ACGAUCAA<u>UAAU</u>-5'<br>Target: 5'-ATAAAGTCATAAAGCTGCTAGTTATTA-3' | (SEQ ID NO: 2761)<br>(SEQ ID NO: 4775)<br>(SEQ ID NO: 6789) |
| LDHA-1894 | 5'-<u>A</u>AGUCAU<u>AAA</u>GCUGC<u>U</u>AGUUAUUat-3'<br>3'-<u>AUUU</u>CAGUAUUUCG<u>A</u>CGAUCAAU<u>AAUA</u>-5'<br>Target: 5'-TAAAGTCATAAAGCTGCTAGTTATTAT-3' | (SEQ ID NO: 2762)<br>(SEQ ID NO: 4776)<br>(SEQ ID NO: 6790) |
| LDHA-1895 | 5'-<u>A</u>GU<u>C</u>AU<u>AAA</u>GCUGC<u>U</u>AGUUAUUAta-3'<br>3'-<u>UUUC</u>AGUAUUUCG<u>A</u>CGAUCAAUA<u>AUAU</u>-5'<br>Target: 5'-AAAGTCATAAAGCTGCTAGTTATTATA-3' | (SEQ ID NO: 2763)<br>(SEQ ID NO: 4777)<br>(SEQ ID NO: 6791) |
| LDHA-1896 | 5'-<u>G</u>U<u>C</u>AU<u>AAA</u>GCUGC<u>U</u>A<u>G</u>UUAUUAUat-3'<br>3'-<u>UUC</u>AGUAUUUCG<u>AC</u>G<u>A</u>UCAAUAU<u>AUA</u>-5'<br>Target: 5'-AAGTCATAAAGCTGCTAGTTATTATAT-3' | (SEQ ID NO: 2764)<br>(SEQ ID NO: 4778)<br>(SEQ ID NO: 6792) |
| LDHA-1897 | 5'-<u>U</u>C<u>A</u>U<u>AAA</u>GCUGCUA<u>G</u>UUAUUAUAtt-3'<br>3'-<u>UC</u>AGUAUUUCGACG<u>A</u>UCAAUAUA<u>UAA</u>-5'<br>Target: 5'-AGTCATAAAGCTGCTAGTTATTATATT-3' | (SEQ ID NO: 2765)<br>(SEQ ID NO: 4779)<br>(SEQ ID NO: 6793) |
| LDHA-1898 | 5'-<u>C</u>AU<u>AAA</u>GCUGCUA<u>G</u>U<u>U</u>AUUAUAUta-3'<br>3'-<u>C</u>AGUAUUUCGACG<u>A</u>UCAAUAUAU<u>AAU</u>-5'<br>Target: 5'-GTCATAAAGCTGCTAGTTATTATATTA-3' | (SEQ ID NO: 2766)<br>(SEQ ID NO: 4780)<br>(SEQ ID NO: 6794) |
| LDHA-1899 | 5'-<u>A</u>U<u>AAA</u>GCUGCUA<u>G</u>U<u>U</u>AUUAUAUUaa-3'<br>3'-<u>A</u>GUAUUUCGACGAUC<u>A</u>AUAUAUAUA<u>AUU</u>-5'<br>Target: 5'-TCATAAAGCTGCTAGTTATTATATTAA-3' | (SEQ ID NO: 2767)<br>(SEQ ID NO: 4781)<br>(SEQ ID NO: 6795) |
| LDHA-1900 | 5'-<u>U</u>A<u>AA</u>GCUGCUAGU<u>U</u>AUUAUAUUAat-3'<br>3'-<u>G</u>UAUUUCGACGAUC<u>A</u>AUAUAUAUA<u>AUUA</u>-5'<br>Target: 5'-CATAAAGCTGCTAGTTATTATATTAAT-3' | (SEQ ID NO: 2768)<br>(SEQ ID NO: 4782)<br>(SEQ ID NO: 6796) |
| LDHA-1901 | 5'-<u>AAA</u>GCUGCUAGUU<u>A</u>UUAUAUUAAtt-3'<br>3'-<u>U</u>AUUUCGACGAUCA<u>A</u>UAUAUAAUUAA-5'<br>Target: 5'-ATAAAGCTGCTAGTTATTATATTAATT-3' | (SEQ ID NO: 2769)<br>(SEQ ID NO: 4783)<br>(SEQ ID NO: 6797) |
| LDHA-1902 | 5'-<u>AA</u>GCUGCUAGUU<u>A</u>U<u>U</u>AUAUUAAUtt-3'<br>3'-<u>AUUU</u>CGACGAUCAA<u>U</u>A<u>U</u>AUAAUU<u>AAA</u>-5'<br>Target: 5'-TAAAGCTGCTAGTTATTATATTAATTT-3' | (SEQ ID NO: 2770)<br>(SEQ ID NO: 4784)<br>(SEQ ID NO: 6798) |
| LDHA-1903 | 5'-<u>A</u>GCUGCUAGU<u>U</u>AU<u>U</u>A<u>U</u>AUUAAUUtg-3'<br>3'-<u>UUUC</u>GACGAUCAAU<u>A</u>AUAUAAUU<u>AAAC</u>-5'<br>Target: 5'-AAAGCTGCTAGTTATTATATTAATTTG-3' | (SEQ ID NO: 2771)<br>(SEQ ID NO: 4785)<br>(SEQ ID NO: 6799) |

TABLE 12-continued

Additional Selected Human Anti-Lactate Dehydrogenase DsiRNA Agents (Asymmetrics)

|  |  |  |  |
|---|---|---|---|
| LDHA-1904 | Target: | 5'-GCUGCUAGUUAUUAUAUUAAUUUgg-3'<br>3'-UUCGACGAUCAAUAAUAUAAUUAAACC-5'<br>5'-AAGCTGCTAGTTATTATATTAATTTGG-3' | (SEQ ID NO: 2772)<br>(SEQ ID NO: 4786)<br>(SEQ ID NO: 6800) |
| LDHA-1905 | Target: | 5'-CUGCUAGUUAUUAUAUUAAUUUGga-3'<br>3'-UCGACGAUCAAUAAUAUAAUUAAACCU-5'<br>5'-AGCTGCTAGTTATTATATTAATTTGGA-3' | (SEQ ID NO: 2773)<br>(SEQ ID NO: 4787)<br>(SEQ ID NO: 6801) |
| LDHA-1906 | Target: | 5'-UGCUAGUUAUUAUAUUAAUUUGGaa-3'<br>3'-CGACGAUCAAUAAUAUAAUUAAACCUU-5'<br>5'-GCTGCTAGTTATTATATTAATTTGGAA-3' | (SEQ ID NO: 2774)<br>(SEQ ID NO: 4788)<br>(SEQ ID NO: 6802) |
| LDHA-1907 | Target: | 5'-GCUAGUUAUUAUAUUAAUUUGGAaa-3'<br>3'-GACGAUCAAUAAUAUAAUUAAACCUUU-5'<br>5'-CTGCTAGTTATTATATTAATTTGGAAA-3' | (SEQ ID NO: 2775)<br>(SEQ ID NO: 4789)<br>(SEQ ID NO: 6803) |
| LDHA-1908 | Target: | 5'-CUAGUUAUUAUAUUAAUUUGGAAat-3'<br>3'-ACGAUCAAUAAUAUAAUUAAACCUUUA-5'<br>5'-TGCTAGTTATTATATTAATTTGGAAAT-3' | (SEQ ID NO: 2776)<br>(SEQ ID NO: 4790)<br>(SEQ ID NO: 6804) |
| LDHA-1909 | Target: | 5'-UAGUUAUUAUAUUAAUUUGGAAAta-3'<br>3'-CGAUCAAUAAUAUAAUUAAACCUUUAU-5'<br>5'-GCTAGTTATTATATTAATTTGGAAATA-3' | (SEQ ID NO: 2777)<br>(SEQ ID NO: 4791)<br>(SEQ ID NO: 6805) |
| LDHA-1910 | Target: | 5'-AGUUAUUAUAUUAAUUUGGAAAUat-3'<br>3'-GAUCAAUAAUAUAAUUAAACCUUUAUA-5'<br>5'-CTAGTTATTATATTAATTTGGAAATAT-3' | (SEQ ID NO: 2778)<br>(SEQ ID NO: 4792)<br>(SEQ ID NO: 6806) |
| LDHA-1911 | Target: | 5'-GUUAUUAUAUUAAUUUGGAAAUAtt-3'<br>3'-AUCAAUAAUAUAAUUAAACCUUUAUAA-5'<br>5'-TAGTTATTATATTAATTTGGAAATATT-3' | (SEQ ID NO: 2779)<br>(SEQ ID NO: 4793)<br>(SEQ ID NO: 6807) |
| LDHA-1912 | Target: | 5'-UUAUUAUAUUAAUUUGGAAAUAUta-3'<br>3'-UCAAUAAUAUAAUUAAACCUUUAUAAU-5'<br>5'-AGTTATTATATTAATTTGGAAATATTA-3' | (SEQ ID NO: 2780)<br>(SEQ ID NO: 4794)<br>(SEQ ID NO: 6808) |
| LDHA-1913 | Target: | 5'-UAUUAUAUUAAUUUGGAAAUAUUag-3'<br>3'-CAAUAAUAUAAUUAAACCUUUAUAAUC-5'<br>5'-GTTATTATATTAATTTGGAAATATTAG-3' | (SEQ ID NO: 2781)<br>(SEQ ID NO: 4795)<br>(SEQ ID NO: 6809) |
| LDHA-1914 | Target: | 5'-AUUAUAUUAAUUUGGAAAUAUUAgg-3'<br>3'-AAUAAUAUAAUUAAACCUUUAUAAUCC-5'<br>5'-TTATTATATTAATTTGGAAATATTAGG-3' | (SEQ ID NO: 2782)<br>(SEQ ID NO: 4796)<br>(SEQ ID NO: 6810) |
| LDHA-1915 | Target: | 5'-UUAUUAAUUUGGAAAUAUUAGgc-3'<br>3'-AUAAUAUAAUUAAACCUUUAUAAUCCG-5'<br>5'-TATTATATTAATTTGGAAATATTAGGC-3' | (SEQ ID NO: 2783)<br>(SEQ ID NO: 4797)<br>(SEQ ID NO: 6811) |
| LDHA-1916 | Target: | 5'-UAUUAAUUUGGAAAUAUUAGGct-3'<br>3'-UAAUAAUUAAACCUUUAUAAUCCGA-5'<br>5'-ATTATATTAATTTGGAAATATTAGGCT-3' | (SEQ ID NO: 2784)<br>(SEQ ID NO: 4798)<br>(SEQ ID NO: 6812) |
| LDHA-1917 | Target: | 5'-AUAUUAAUUUGGAAAUAUUAGGCta-3'<br>3'-AAUAUAAUUAAACCUUUAUAAUCCGAU-5'<br>5'-TTATATTAATTTGGAAATATTAGGCTA-3' | (SEQ ID NO: 2785)<br>(SEQ ID NO: 4799)<br>(SEQ ID NO: 6813) |
| LDHA-1918 | Target: | 5'-UAUUAAUUUGGAAAUAUUAGGCUat-3'<br>3'-AUAUAAUUAAACCUUUAUAAUCCGAUA-5'<br>5'-TATATTAATTTGGAAATATTAGGCTAT-3' | (SEQ ID NO: 2786)<br>(SEQ ID NO: 4800)<br>(SEQ ID NO: 6814) |
| LDHA-1919 | Target: | 5'-AUUAAUUUGGAAAUAUUAGGCUAtt-3'<br>3'-UAUAAUUAAACCUUUAUAAUCCGAUAA-5'<br>5'-ATATTAATTTGGAAATATTAGGCTATT-3' | (SEQ ID NO: 2787)<br>(SEQ ID NO: 4801)<br>(SEQ ID NO: 6815) |
| LDHA-1920 | Target: | 5'-UUAAUUUGGAAAUAUUAGGCUAUtc-3'<br>3'-AUAAUUAAACCUUUAUAAUCCGAUAAG-5'<br>5'-TATTAATTTGGAAATATTAGGCTATTC-3' | (SEQ ID NO: 2788)<br>(SEQ ID NO: 4802)<br>(SEQ ID NO: 6816) |
| LDHA-1921 | Target: | 5'-UAAUUUGGAAAUAUUAGGCUAUUct-3'<br>3'-UAAUUAAACCUUUAUAAUCCGAUAAGA-5'<br>5'-ATTAATTTGGAAATATTAGGCTATTCT-3' | (SEQ ID NO: 2789)<br>(SEQ ID NO: 4803)<br>(SEQ ID NO: 6817) |
| LDHA-1922 | Target: | 5'-AAUUUGGAAAUAUUAGGCUAUUCtt-3'<br>3'-AAUUAAACCUUUAUAAUCCGAUAAGAA-5'<br>5'-TTAATTTGGAAATATTAGGCTATTCTT-3' | (SEQ ID NO: 2790)<br>(SEQ ID NO: 4804)<br>(SEQ ID NO: 6818) |

TABLE 12-continued

Additional Selected Human Anti-Lactate Dehydrogenase DsiRNA Agents (Asymmetrics)

```
                    5'-AUUUGGAAAUAUUAGGCUAUUCUtg-3'    (SEQ ID NO: 2791)
                    3'-AUUAAACCUUUAUAAUCCGAUAAGAAC-5'  (SEQ ID NO: 4805)
LDHA-1923 Target:   5'-TAATTTGGAAATATTAGGCTATTCTTG-3'  (SEQ ID NO: 6819)

5'-UUUGGAAAUAUUAGGCUAUUCUUgg-3'    (SEQ ID NO: 2792)
                    3'-UUAAACCUUUAUAAUCCGAUAAGAACC-5'  (SEQ ID NO: 4806)
LDHA-1924 Target:   5'-AATTTGGAAATATTAGGCTATTCTTGG-3' (SEQ ID NO: 6820)

5'-UUGGAAAUAUUAGGCUAUUCUUGgg-3'    (SEQ ID NO: 2793)
                    3'-UAAACCUUUAUAAUCCGAUAAGAACCC-5'  (SEQ ID NO: 4807)
LDHA-1925 Target:   5'-ATTTGGAAATATTAGGCTATTCTTGGG-3' (SEQ ID NO: 6821)

5'-UGGAAAUAUUAGGCUAUUCUUGGgc-3'    (SEQ ID NO: 2794)
                    3'-AAACCUUUAUAAUCCGAUAAGAACCCG-5'  (SEQ ID NO: 4808)
LDHA-1926 Target:   5'-TTTGGAAATATTAGGCTATTCTTGGGC-3' (SEQ ID NO: 6822)

5'-GGAAAUAUUAGGCUAUUCUUGGGca-3'    (SEQ ID NO: 2795)
                    3'-AACCUUUAUAAUCCGAUAAGAACCCGU-5'  (SEQ ID NO: 4809)
LDHA-1927 Target:   5'-TTGGAAATATTAGGCTATTCTTGGGCA-3' (SEQ ID NO: 6823)

5'-GAAAUAUUAGGCUAUUCUUGGGCaa-3'    (SEQ ID NO: 2796)
                    3'-ACCUUUAUAAUCCGAUAAGAACCCGUU-5'  (SEQ ID NO: 4810)
LDHA-1928 Target:   5'-TGGAAATATTAGGCTATTCTTGGGCAA-3' (SEQ ID NO: 6824)

5'-AAAUAUUAGGCUAUUCUUGGGCAac-3'    (SEQ ID NO: 2797)
                    3'-CCUUUAUAAUCCGAUAAGAACCCGUUG-5'  (SEQ ID NO: 4811)
LDHA-1929 Target:   5'-GGAAATATTAGGCTATTCTTGGGCAAC-3' (SEQ ID NO: 6825)

5'-AAUAUUAGGCUAUUCUUGGGCAAcc-3'    (SEQ ID NO: 2798)
                    3'-CUUUAUAAUCCGAUAAGAACCCGUUGG-5'  (SEQ ID NO: 4812)
LDHA-1930 Target:   5'-GAAATATTAGGCTATTCTTGGGCAACC-3' (SEQ ID NO: 6826)

5'-AUAUUAGGCUAUUCUUGGGCAACcc-3'    (SEQ ID NO: 2799)
                    3'-UUUAUAAUCCGAUAAGAACCCGUUGGG-5'  (SEQ ID NO: 4813)
LDHA-1931 Target:   5'-AAATATTAGGCTATTCTTGGGCAACCC-3' (SEQ ID NO: 6827)

5'-UAUUAGGCUAUUCUUGGGCAACCct-3'    (SEQ ID NO: 2800)
                    3'-UUAUAAUCCGAUAAGAACCCGUUGGGA-5'  (SEQ ID NO: 4814)
LDHA-1932 Target:   5'-AATATTAGGCTATTCTTGGGCAACCCT-3' (SEQ ID NO: 6828)

5'-AUUAGGCUAUUCUUGGGCAACCCtg-3'    (SEQ ID NO: 2801)
                    3'-UAUAAUCCGAUAAGAACCCGUUGGGAC-5'  (SEQ ID NO: 4815)
LDHA-1933 Target:   5'-ATATTAGGCTATTCTTGGGCAACCCTG-3' (SEQ ID NO: 6829)

5'-UUAGGCUAUUCUUGGGCAACCCUgc-3'    (SEQ ID NO: 2802)
                    3'-AUAAUCCGAUAAGAACCCGUUGGGACG-5'  (SEQ ID NO: 4816)
LDHA-1934 Target:   5'-TATTAGGCTATTCTTGGGCAACCCTGC-3' (SEQ ID NO: 6830)

5'-UAGGCUAUUCUUGGGCAACCCUGca-3'    (SEQ ID NO: 2803)
                    3'-UAAUCCGAUAAGAACCCGUUGGGACGU-5'  (SEQ ID NO: 4817)
LDHA-1935 Target:   5'-ATTAGGCTATTCTTGGGCAACCCTGCA-3' (SEQ ID NO: 6831)

5'-AGGCUAUUCUUGGGCAACCCUGCaa-3'    (SEQ ID NO: 2804)
                    3'-AAUCCGAUAAGAACCCGUUGGGACGUU-5'  (SEQ ID NO: 4818)
LDHA-1936 Target:   5'-TTAGGCTATTCTTGGGCAACCCTGCAA-3' (SEQ ID NO: 6832)

5'-GGCUAUUCUUGGGCAACCCUGCAac-3'    (SEQ ID NO: 2805)
                    3'-AUCCGAUAAGAACCCGUUGGGACGUUG-5'  (SEQ ID NO: 4819)
LDHA-1937 Target:   5'-TAGGCTATTCTTGGGCAACCCTGCAAC-3' (SEQ ID NO: 6833)

5'-GCUAUUCUUGGGCAACCCUGCAAcg-3'    (SEQ ID NO: 2806)
                    3'-UCCGAUAAGAACCCGUUGGGACGUUGC-5'  (SEQ ID NO: 4820)
LDHA-1938 Target:   5'-AGGCTATTCTTGGGCAACCCTGCAACG-3' (SEQ ID NO: 6834)

5'-CUAUUCUUGGGCAACCCUGCAACga-3'    (SEQ ID NO: 2807)
                    3'-CCGAUAAGAACCCGUUGGGACGUUGCU-5'  (SEQ ID NO: 4821)
LDHA-1939 Target:   5'-GGCTATTCTTGGGCAACCCTGCAACGA-3' (SEQ ID NO: 6835)

5'-UAUUCUUGGGCAACCCUGCAACGat-3'    (SEQ ID NO: 2808)
                    3'-CGAUAAGAACCCGUUGGGACGUUGCUA-5'  (SEQ ID NO: 4822)
LDHA-1940 Target:   5'-GCTATTCTTGGGCAACCCTGCAACGAT-3' (SEQ ID NO: 6836)

5'-AUUCUUGGGCAACCCUGCAACGAtt-3'    (SEQ ID NO: 2809)
                    3'-GAUAAGAACCCGUUGGGACGUUGCUAA-5'  (SEQ ID NO: 4823)
LDHA-1941 Target:   5'-CTATTCTTGGGCAACCCTGCAACGATT-3' (SEQ ID NO: 6837)
```

TABLE 12-continued

Additional Selected Human Anti-Lactate Dehydrogenase DsiRNA Agents (Asymmetrics)

|  |  |  |
| --- | --- | --- |
|  | 5'-UUCUUGGGCAACCCUGCAACGAUtt-3' | (SEQ ID NO: 2810) |
|  | 3'-AUAAGAACCCGUUGGGACGUUGCUAAA-5' | (SEQ ID NO: 4824) |
| LDHA-1942 Target: | 5'-TATTCTTGGGCAACCCTGCAACGATTT-3' | (SEQ ID NO: 6838) |
|  | 5'-UCUUGGGCAACCCUGCAACGAUUt-3' | (SEQ ID NO: 2811) |
|  | 3'-UAAGAACCCGUUGGGACGUUGCUAAAA-5' | (SEQ ID NO: 4825) |
| LDHA-1943 Target: | 5'-ATTCTTGGGCAACCCTGCAACGATTTT-3' | (SEQ ID NO: 6839) |
|  | 5'-CUUGGGCAACCCUGCAACGAUUUtt-3' | (SEQ ID NO: 2812) |
|  | 3'-AAGAACCCGUUGGGACGUUGCUAAAAA-5' | (SEQ ID NO: 4826) |
| LDHA-1944 Target: | 5'-TTCTTGGGCAACCCTGCAACGATTTTT-3' | (SEQ ID NO: 6840) |
|  | 5'-UUGGGCAACCCUGCAACGAUUUUtt-3' | (SEQ ID NO: 2813) |
|  | 3'-AGAACCCGUUGGGACGUUGCUAAAAAA-5' | (SEQ ID NO: 4827) |
| LDHA-1945 Target: | 5'-TCTTGGGCAACCCTGCAACGATTTTTT-3' | (SEQ ID NO: 6841) |
|  | 5'-UGGGCAACCCUGCAACGAUUUUUtc-3' | (SEQ ID NO: 2814) |
|  | 3'-GAACCCGUUGGGACGUUGCUAAAAAAG-5' | (SEQ ID NO: 4828) |
| LDHA-1946 Target: | 5'-CTTGGGCAACCCTGCAACGATTTTTTC-3' | (SEQ ID NO: 6842) |
|  | 5'-GGGCAACCCUGCAACGAUUUUUUct-3' | (SEQ ID NO: 2815) |
|  | 3'-AACCCGUUGGGACGUUGCUAAAAAAGA-5' | (SEQ ID NO: 4829) |
| LDHA-1947 Target: | 5'-TTGGGCAACCCTGCAACGATTTTTTCT-3' | (SEQ ID NO: 6843) |
|  | 5'-GGCAACCCUGCAACGAUUUUUUCta-3' | (SEQ ID NO: 2816) |
|  | 3'-ACCCGUUGGGACGUUGCUAAAAAAGAU-5' | (SEQ ID NO: 4830) |
| LDHA-1948 Target: | 5'-TGGGCAACCCTGCAACGATTTTTTCTA-3' | (SEQ ID NO: 6844) |
|  | 5'-GCAACCCUGCAACGAUUUUUUCUaa-3' | (SEQ ID NO: 2817) |
|  | 3'-CCCGUUGGGACGUUGCUAAAAAAGAUU-5' | (SEQ ID NO: 4831) |
| LDHA-1949 Target: | 5'-GGGCAACCCTGCAACGATTTTTTCTAA-3' | (SEQ ID NO: 6845) |
|  | 5'-CAACCCUGCAACGAUUUUUUCUAac-3' | (SEQ ID NO: 2818) |
|  | 3'-CCGUUGGGACGUUGCUAAAAAAGAUUG-5' | (SEQ ID NO: 4832) |
| LDHA-1950 Target: | 5'-GGCAACCCTGCAACGATTTTTTCTAAC-3' | (SEQ ID NO: 6846) |
|  | 5'-AACCCUGCAACGAUUUUUUCUAAca-3' | (SEQ ID NO: 2819) |
|  | 3'-CGUUGGGACGUUGCUAAAAAAGAUUGU-5' | (SEQ ID NO: 4833) |
| LDHA-1951 Target: | 5'-GCAACCCTGCAACGATTTTTTCTAACA-3' | (SEQ ID NO: 6847) |
|  | 5'-ACCCUGCAACGAUUUUUUCUAACag-3' | (SEQ ID NO: 2820) |
|  | 3'-GUUGGGACGUUGCUAAAAAAGAUUGUC-5' | (SEQ ID NO: 4834) |
| LDHA-1952 Target: | 5'-CAACCCTGCAACGATTTTTTCTAACAG-3' | (SEQ ID NO: 6848) |
|  | 5'-CCCUGCAACGAUUUUUUCUAACAgg-3' | (SEQ ID NO: 2821) |
|  | 3'-UUGGGACGUUGCUAAAAAAGAUUGUCC-5' | (SEQ ID NO: 4835) |
| LDHA-1953 Target: | 5'-AACCCTGCAACGATTTTTTCTAACAGG-3' | (SEQ ID NO: 6849) |
|  | 5'-CCUGCAACGAUUUUUUCUAACAGgg-3' | (SEQ ID NO: 2822) |
|  | 3'-UGGGACGUUGCUAAAAAAGAUUGUCCC-5' | (SEQ ID NO: 4836) |
| LDHA-1954 Target: | 5'-ACCCTGCAACGATTTTTTCTAACAGGG-3' | (SEQ ID NO: 6850) |
|  | 5'-CUGCAACGAUUUUUUCUAACAGGga-3' | (SEQ ID NO: 2823) |
|  | 3'-GGGACGUUGCUAAAAAAGAUUGUCCCU-5' | (SEQ ID NO: 4837) |
| LDHA-1955 Target: | 5'-CCCTGCAACGATTTTTTCTAACAGGGA-3' | (SEQ ID NO: 6851) |
|  | 5'-UGCAACGAUUUUUUCUAACAGGGat-3' | (SEQ ID NO: 2824) |
|  | 3'-GGACGUUGCUAAAAAAGAUUGUCCCUA-5' | (SEQ ID NO: 4838) |
| LDHA-1956 Target: | 5'-CCTGCAACGATTTTTTCTAACAGGGAT-3' | (SEQ ID NO: 6852) |
|  | 5'-GCAACGAUUUUUUCUAACAGGGAta-3' | (SEQ ID NO: 2825) |
|  | 3'-GACGUUGCUAAAAAAGAUUGUCCCUAU-5' | (SEQ ID NO: 4839) |
| LDHA-1957 Target: | 5'-CTGCAACGATTTTTTCTAACAGGGATA-3' | (SEQ ID NO: 6853) |
|  | 5'-CAACGAUUUUUUCUAACAGGGAUat-3' | (SEQ ID NO: 2826) |
|  | 3'-ACGUUGCUAAAAAAGAUUGUCCCUAUA-5' | (SEQ ID NO: 4840) |
| LDHA-1958 Target: | 5'-TGCAACGATTTTTTCTAACAGGGATAT-3' | (SEQ ID NO: 6854) |
|  | 5'-AACGAUUUUUUCUAACAGGGAUAtt-3' | (SEQ ID NO: 2827) |
|  | 3'-CGUUGCUAAAAAAGAUUGUCCCUAUAA-5' | (SEQ ID NO: 4841) |
| LDHA-1959 Target: | 5'-GCAACGATTTTTTCTAACAGGGATATT-3' | (SEQ ID NO: 6855) |
|  | 5'-ACGAUUUUUUCUAACAGGGAUAUta-3' | (SEQ ID NO: 2828) |
|  | 3'-GUUGCUAAAAAAGAUUGUCCCUAUAAU-5' | (SEQ ID NO: 4842) |
| LDHA-1960 Target: | 5'-CAACGATTTTTTCTAACAGGGATATTA-3' | (SEQ ID NO: 6856) |

TABLE 12-continued

Additional Selected Human Anti-Lactate Dehydrogenase DsiRNA Agents (Asymmetrics)

| | | |
|---|---|---|
| LDHA-1961 Target: | 5'-CGAUUUUUCUAACAGGGAUAUUat-3'<br>3'-UUGCUAAAAAGAUUGUCCCUAUAAUA-5'<br>5'-AACGATTTTTCTAACAGGGATATTAT-3' | (SEQ ID NO: 2829)<br>(SEQ ID NO: 4843)<br>(SEQ ID NO: 6857) |
| LDHA-1962 Target: | 5'-GAUUUUUCUAACAGGGAUAUUAtt-3'<br>3'-UGCUAAAAAGAUUGUCCCUAUAAUAA-5'<br>5'-ACGATTTTTCTAACAGGGATATTATT-3' | (SEQ ID NO: 2830)<br>(SEQ ID NO: 4844)<br>(SEQ ID NO: 6858) |
| LDHA-1963 Target: | 5'-AUUUUUCUAACAGGGAUAUUAUtg-3'<br>3'-GCUAAAAAGAUUGUCCCUAUAAUAAC-5'<br>5'-CGATTTTTCTAACAGGGATATTATTG-3' | (SEQ ID NO: 2831)<br>(SEQ ID NO: 4845)<br>(SEQ ID NO: 6859) |
| LDHA-1964 Target: | 5'-UUUUUCUAACAGGGAUAUUAUUga-3'<br>3'-CUAAAAAGAUUGUCCCUAUAAUAACU-5'<br>5'-GATTTTTCTAACAGGGATATTATTGA-3' | (SEQ ID NO: 2832)<br>(SEQ ID NO: 4846)<br>(SEQ ID NO: 6860) |
| LDHA-1965 Target: | 5'-UUUUCUAACAGGGAUAUUAUUGac-3'<br>3'-UAAAAAGAUUGUCCCUAUAAUAACUG-5'<br>5'-ATTTTTCTAACAGGGATATTATTGAC-3' | (SEQ ID NO: 2833)<br>(SEQ ID NO: 4847)<br>(SEQ ID NO: 6861) |
| LDHA-1966 Target: | 5'-UUUUCUAACAGGGAUAUUAUUGAct-3'<br>3'-AAAAAGAUUGUCCCUAUAAUAACUGA-5'<br>5'-TTTTTCTAACAGGGATATTATTGACT-3' | (SEQ ID NO: 2834)<br>(SEQ ID NO: 4848)<br>(SEQ ID NO: 6862) |
| LDHA-1967 Target: | 5'-UUUCUAACAGGGAUAUUAUUGACta-3'<br>3'-AAAAGAUUGUCCCUAUAAUAACUGAU-5'<br>5'-TTTTTCTAACAGGGATATTATTGACTA-3' | (SEQ ID NO: 2835)<br>(SEQ ID NO: 4849)<br>(SEQ ID NO: 6863) |
| LDHA-1968 Target: | 5'-UUCUAACAGGGAUAUUAUUGACUaa-3'<br>3'-AAAGAUUGUCCCUAUAAUAACUGAUU-5'<br>5'-TTTTCTAACAGGGATATTATTGACTAA-3' | (SEQ ID NO: 2836)<br>(SEQ ID NO: 4850)<br>(SEQ ID NO: 6864) |
| LDHA-1969 Target: | 5'-UCUAACAGGGAUAUUAUUGACUAat-3'<br>3'-AAAGAUUGUCCCUAUAAUAACUGAUUA-5'<br>5'-TTTCTAACAGGGATATTATTGACTAAT-3' | (SEQ ID NO: 2837)<br>(SEQ ID NO: 4851)<br>(SEQ ID NO: 6865) |
| LDHA-1970 Target: | 5'-CUAACAGGGAUAUUAUUGACUAAta-3'<br>3'-AAGAUUGUCCCUAUAAUAACUGAUUAU-5'<br>5'-TTCTAACAGGGATATTATTGACTAATA-3' | (SEQ ID NO: 2838)<br>(SEQ ID NO: 4852)<br>(SEQ ID NO: 6866) |
| LDHA-1971 Target: | 5'-UAACAGGGAUAUUAUUGACUAAUag-3'<br>3'-AGAUUGUCCCUAUAAUAACUGAUUAUC-5'<br>5'-TCTAACAGGGATATTATTGACTAATAG-3' | (SEQ ID NO: 2839)<br>(SEQ ID NO: 4853)<br>(SEQ ID NO: 6867) |
| LDHA-1972 Target: | 5'-AACAGGGAUAUUAUUGACUAAUAgc-3'<br>3'-GAUUGUCCCUAUAAUAACUGAUUAUCG-5'<br>5'-CTAACAGGGATATTATTGACTAATAGC-3' | (SEQ ID NO: 2840)<br>(SEQ ID NO: 4854)<br>(SEQ ID NO: 6868) |
| LDHA-1973 Target: | 5'-ACAGGGAUAUUAUUGACUAAUAGca-3'<br>3'-AUUGUCCCUAUAAUAACUGAUUAUCGU-5'<br>5'-TAACAGGGATATTATTGACTAATAGCA-3' | (SEQ ID NO: 2841)<br>(SEQ ID NO: 4855)<br>(SEQ ID NO: 6869) |
| LDHA-1974 Target: | 5'-CAGGGAUAUUAUUGACUAAUAGCag-3'<br>3'-UUGUCCCUAUAAUAACUGAUUAUCGUC-5'<br>5'-AACAGGGATATTATTGACTAATAGCAG-3' | (SEQ ID NO: 2842)<br>(SEQ ID NO: 4856)<br>(SEQ ID NO: 6870) |
| LDHA-1975 Target: | 5'-AGGGAUAUUAUUGACUAAUAGCAga-3'<br>3'-UGUCCCUAUAAUAACUGAUUAUCGUCU-5'<br>5'-ACAGGGATATTATTGACTAATAGCAGA-3' | (SEQ ID NO: 2843)<br>(SEQ ID NO: 4857)<br>(SEQ ID NO: 6871) |
| LDHA-1976 Target: | 5'-GGGAUAUUAUUGACUAAUAGCAGag-3'<br>3'-GUCCCUAUAAUAACUGAUUAUCGUCUC-5'<br>5'-CAGGGATATTATTGACTAATAGCAGAG-3' | (SEQ ID NO: 2844)<br>(SEQ ID NO: 4858)<br>(SEQ ID NO: 6872) |
| LDHA-1977 Target: | 5'-GGAUAUUAUUGACUAAUAGCAGAgg-3'<br>3'-UCCCUAUAAUAACUGAUUAUCGUCUCC-5'<br>5'-AGGGATATTATTGACTAATAGCAGAGG-3' | (SEQ ID NO: 2845)<br>(SEQ ID NO: 4859)<br>(SEQ ID NO: 6873) |
| LDHA-1978 Target: | 5'-GAUAUUAUUGACUAAUAGCAGAGga-3'<br>3'-CCCUAUAAUAACUGAUUAUCGUCUCCU-5'<br>5'-GGGATATTATTGACTAATAGCAGAGGA-3' | (SEQ ID NO: 2846)<br>(SEQ ID NO: 4860)<br>(SEQ ID NO: 6874) |
| LDHA-1979 Target: | 5'-AUAUUAUUGACUAAUAGCAGAGGat-3'<br>3'-CCUAUAAUAACUGAUUAUCGUCUCCUA-5'<br>5'-GGATATTATTGACTAATAGCAGAGGAT-3' | (SEQ ID NO: 2847)<br>(SEQ ID NO: 4861)<br>(SEQ ID NO: 6875) |

TABLE 12-continued

Additional Selected Human Anti-Lactate Dehydrogenase DsiRNA Agents (Asymmetrics)

```
                   5'-UAUUAUUGACUAAUAGCAGAGGAtg-3'      (SEQ ID NO: 2848)
                   3'-CUAUAAUAACUGAUUAUCGUCUCCUAC-5'    (SEQ ID NO: 4862)
LDHA-1980 Target:  5'-GATATTATTGACTAATAGCAGAGGATG-3'    (SEQ ID NO: 6876)

5'-AUUAUUGACUAAUAGCAGAGGAUgt-3'      (SEQ ID NO: 2849)
                   3'-UAUAAUAACUGAUUAUCGUCUCCUACA-5'    (SEQ ID NO: 4863)
LDHA-1981 Target:  5'-ATATTATTGACTAATAGCAGAGGATGT-3'    (SEQ ID NO: 6877)

5'-UUAUUGACUAAUAGCAGAGGAUGta-3'      (SEQ ID NO: 2850)
                   3'-AUAAUAACUGAUUAUCGUCUCCUACAU-5'    (SEQ ID NO: 4864)
LDHA-1982 Target:  5'-TATTATTGACTAATAGCAGAGGATGTA-3'    (SEQ ID NO: 6878)

5'-UAUUGACUAAUAGCAGAGGAUGUaa-3'      (SEQ ID NO: 2851)
                   3'-UAAUAACUGAUUAUCGUCUCCUACAUU-5'    (SEQ ID NO: 4865)
LDHA-1983 Target:  5'-ATTATTGACTAATAGCAGAGGATGTAA-3'    (SEQ ID NO: 6879)

5'-AUUGACUAAUAGCAGAGGAUGUAat-3'      (SEQ ID NO: 2852)
                   3'-AAUAACUGAUUAUCGUCUCCUACAUUA-5'    (SEQ ID NO: 4866)
LDHA-1984 Target:  5'-TTATTGACTAATAGCAGAGGATGTAAT-3'    (SEQ ID NO: 6880)

5'-UUGACUAAUAGCAGAGGAUGUAAta-3'      (SEQ ID NO: 2853)
                   3'-AUAACUGAUUAUCGUCUCCUACAUUAU-5'    (SEQ ID NO: 4867)
LDHA-1985 Target:  5'-TATTGACTAATAGCAGAGGATGTAATA-3'    (SEQ ID NO: 6881)

5'-UGACUAAUAGCAGAGGAUGUAAUag-3'      (SEQ ID NO: 2854)
                   3'-UAACUGAUUAUCGUCUCCUACAUUAUC-5'    (SEQ ID NO: 4868)
LDHA-1986 Target:  5'-ATTGACTAATAGCAGAGGATGTAATAG-3'    (SEQ ID NO: 6882)

5'-GACUAAUAGCAGAGGAUGUAAUAgt-3'      (SEQ ID NO: 2855)
                   3'-AACUGAUUAUCGUCUCCUACAUUAUCA-5'    (SEQ ID NO: 4869)
LDHA-1987 Target:  5'-TTGACTAATAGCAGAGGATGTAATAGT-3'    (SEQ ID NO: 6883)

5'-ACUAAUAGCAGAGGAUGUAAUAGtc-3'      (SEQ ID NO: 2856)
                   3'-ACUGAUUAUCGUCUCCUACAUUAUCAG-5'    (SEQ ID NO: 4870)
LDHA-1988 Target:  5'-TGACTAATAGCAGAGGATGTAATAGTC-3'    (SEQ ID NO: 6884)

5'-CUAAUAGCAGAGGAUGUAAUAGUca-3'      (SEQ ID NO: 2857)
                   3'-CUGAUUAUCGUCUCCUACAUUAUCAGU-5'    (SEQ ID NO: 4871)
LDHA-1989 Target:  5'-GACTAATAGCAGAGGATGTAATAGTCA-3'    (SEQ ID NO: 6885)

5'-UAAUAGCAGAGGAUGUAAUAGUCaa-3'      (SEQ ID NO: 2858)
                   3'-UGAUUAUCGUCUCCUACAUUAUCAGUU-5'    (SEQ ID NO: 4872)
LDHA-1990 Target:  5'-ACTAATAGCAGAGGATGTAATAGTCAA-3'    (SEQ ID NO: 6886)

5'-AAUAGCAGAGGAUGUAAUAGUCAac-3'      (SEQ ID NO: 2859)
                   3'-GAUUAUCGUCUCCUACAUUAUCAGUUG-5'    (SEQ ID NO: 4873)
LDHA-1991 Target:  5'-CTAATAGCAGAGGATGTAATAGTCAAC-3'    (SEQ ID NO: 6887)

5'-AUAGCAGAGGAUGUAAUAGUCAAct-3'      (SEQ ID NO: 2860)
                   3'-AUUAUCGUCUCCUACAUUAUCAGUUGA-5'    (SEQ ID NO: 4874)
LDHA-1992 Target:  5'-TAATAGCAGAGGATGTAATAGTCAACT-3'    (SEQ ID NO: 6888)

5'-UAGCAGAGGAUGUAAUAGUCAACtg-3'      (SEQ ID NO: 2861)
                   3'-UUAUCGUCUCCUACAUUAUCAGUUGAC-5'    (SEQ ID NO: 4875)
LDHA-1993 Target:  5'-AATAGCAGAGGATGTAATAGTCAACTG-3'    (SEQ ID NO: 6889)

5'-AGCAGAGGAUGUAAUAGUCAACUga-3'      (SEQ ID NO: 2862)
                   3'-UAUCGUCUCCUACAUUAUCAGUUGACU-5'    (SEQ ID NO: 4876)
LDHA-1994 Target:  5'-ATAGCAGAGGATGTAATAGTCAACTGA-3'    (SEQ ID NO: 6890)

5'-GCAGAGGAUGUAAUAGUCAACUGag-3'      (SEQ ID NO: 2863)
                   3'-AUCGUCUCCUACAUUAUCAGUUGACUC-5'    (SEQ ID NO: 4877)
LDHA-1995 Target:  5'-TAGCAGAGGATGTAATAGTCAACTGAG-3'    (SEQ ID NO: 6891)

5'-CAGAGGAUGUAAUAGUCAACUGAgt-3'      (SEQ ID NO: 2864)
                   3'-UCGUCUCCUACAUUAUCAGUUGACUCA-5'    (SEQ ID NO: 4878)
LDHA-1996 Target:  5'-AGCAGAGGATGTAATAGTCAACTGAGT-3'    (SEQ ID NO: 6892)

5'-AGAGGAUGUAAUAGUCAACUGAGtt-3'      (SEQ ID NO: 2865)
                   3'-CGUCUCCUACAUUAUCAGUUGACUCAA-5'    (SEQ ID NO: 4879)
LDHA-1997 Target:  5'-GCAGAGGATGTAATAGTCAACTGAGTT-3'    (SEQ ID NO: 6893)

5'-GAGGAUGUAAUAGUCAACUGAGUtg-3'      (SEQ ID NO: 2866)
                   3'-GUCUCCUACAUUAUCAGUUGACUCAAC-5'    (SEQ ID NO: 4880)
LDHA-1998 Target:  5'-CAGAGGATGTAATAGTCAACTGAGTTG-3'    (SEQ ID NO: 6894)
```

TABLE 12-continued

Additional Selected Human Anti-Lactate Dehydrogenase DsiRNA Agents (Asymmetrics)

|  |  |  |
|---|---|---|
| LDHA-1999 | 5'-AGGAUGUAAUAGUCAACUGAGUUGt-3'<br>3'-UCUCCUACAUUAUCAGUUGACUCAACA-5'<br>Target: 5'-AGAGGATGTAATAGTCAACTGAGTTGT-3' | (SEQ ID NO: 2867)<br>(SEQ ID NO: 4881)<br>(SEQ ID NO: 6895) |
| LDHA-2000 | 5'-GGAUGUAAUAGUCAACUGAGUUGta-3'<br>3'-CUCCUACAUUAUCAGUUGACUCAACAU-5'<br>Target: 5'-GAGGATGTAATAGTCAACTGAGTTGTA-3' | (SEQ ID NO: 2868)<br>(SEQ ID NO: 4882)<br>(SEQ ID NO: 6896) |
| LDHA-2001 | 5'-GAUGUAAUAGUCAACUGAGUUGUat-3'<br>3'-UCCUACAUUAUCAGUUGACUCAACAUA-5'<br>Target: 5'-AGGATGTAATAGTCAACTGAGTTGTAT-3' | (SEQ ID NO: 2869)<br>(SEQ ID NO: 4883)<br>(SEQ ID NO: 6897) |
| LDHA-2002 | 5'-AUGUAAUAGUCAACUGAGUUGUAtt-3'<br>3'-CCUACAUUAUCAGUUGACUCAACAUAA-5'<br>Target: 5'-GGATGTAATAGTCAACTGAGTTGTATT-3' | (SEQ ID NO: 2870)<br>(SEQ ID NO: 4884)<br>(SEQ ID NO: 6898) |
| LDHA-2003 | 5'-UGUAAUAGUCAACUGAGUUGUAUtg-3'<br>3'-CUACAUUAUCAGUUGACUCAACAUAAC-5'<br>Target: 5'-GATGTAATAGTCAACTGAGTTGTATTG-3' | (SEQ ID NO: 2871)<br>(SEQ ID NO: 4885)<br>(SEQ ID NO: 6899) |
| LDHA-2004 | 5'-GUAAUAGUCAACUGAGUUGUAUUgg-3'<br>3'-UACAUUAUCAGUUGACUCAACAUAACC-5'<br>Target: 5'-ATGTAATAGTCAACTGAGTTGTATTGG-3' | (SEQ ID NO: 2872)<br>(SEQ ID NO: 4886)<br>(SEQ ID NO: 6900) |
| LDHA-2005 | 5'-UAAUAGUCAACUGAGUUGUAUUGgt-3'<br>3'-ACAUUAUCAGUUGACUCAACAUAACCA-5'<br>Target: 5'-TGTAATAGTCAACTGAGTTGTATTGGT-3' | (SEQ ID NO: 2873)<br>(SEQ ID NO: 4887)<br>(SEQ ID NO: 6901) |
| LDHA-2006 | 5'-AAUAGUCAACUGAGUUGUAUUGGta-3'<br>3'-CAUUAUCAGUUGACUCAACAUAACCAU-5'<br>Target: 5'-GTAATAGTCAACTGAGTTGTATTGGTA-3' | (SEQ ID NO: 2874)<br>(SEQ ID NO: 4888)<br>(SEQ ID NO: 6902) |
| LDHA-2007 | 5'-AUAGUCAACUGAGUUGUAUUGGUac-3'<br>3'-AUUAUCAGUUGACUCAACAUAACCAUG-5'<br>Target: 5'-TAATAGTCAACTGAGTTGTATTGGTAC-3' | (SEQ ID NO: 2875)<br>(SEQ ID NO: 4889)<br>(SEQ ID NO: 6903) |
| LDHA-2008 | 5'-UAGUCAACUGAGUUGUAUUGGUAcc-3'<br>3'-UUAUCAGUUGACUCAACAUAACCAUGG-5'<br>Target: 5'-AATAGTCAACTGAGTTGTATTGGTACC-3' | (SEQ ID NO: 2876)<br>(SEQ ID NO: 4890)<br>(SEQ ID NO: 6904) |
| LDHA-2009 | 5'-AGUCAACUGAGUUGUAUUGGUACca-3'<br>3'-UAUCAGUUGACUCAACAUAACCAUGGU-5'<br>Target: 5'-ATAGTCAACTGAGTTGTATTGGTACCA-3' | (SEQ ID NO: 2877)<br>(SEQ ID NO: 4891)<br>(SEQ ID NO: 6905) |
| LDHA-2010 | 5'-GUCAACUGAGUUGUAUUGGUACCac-3'<br>3'-AUCAGUUGACUCAACAUAACCAUGGUG-5'<br>Target: 5'-TAGTCAACTGAGTTGTATTGGTACCAC-3' | (SEQ ID NO: 2878)<br>(SEQ ID NO: 4892)<br>(SEQ ID NO: 6906) |
| LDHA-2011 | 5'-UCAACUGAGUUGUAUUGGUACCAct-3'<br>3'-UCAGUUGACUCAACAUAACCAUGGUGA-5'<br>Target: 5'-AGTCAACTGAGTTGTATTGGTACCACT-3' | (SEQ ID NO: 2879)<br>(SEQ ID NO: 4893)<br>(SEQ ID NO: 6907) |
| LDHA-2012 | 5'-CAACUGAGUUGUAUUGGUACCActt-3'<br>3'-CAGUUGACUCAACAUAACCAUGGUGAA-5'<br>Target: 5'-GTCAACTGAGTTGTATTGGTACCACTT-3' | (SEQ ID NO: 2880)<br>(SEQ ID NO: 4894)<br>(SEQ ID NO: 6908) |
| LDHA-2013 | 5'-AACUGAGUUGUAUUGGUACCACUtc-3'<br>3'-AGUUGACUCAACAUAACCAUGGUGAAG-5'<br>Target: 5'-TCAACTGAGTTGTATTGGTACCACTTC-3' | (SEQ ID NO: 2881)<br>(SEQ ID NO: 4895)<br>(SEQ ID NO: 6909) |
| LDHA-2014 | 5'-ACUGAGUUGUAUUGGUACCACUUcc-3'<br>3'-GUUGACUCAACAUAACCAUGGUGAAGG-5'<br>Target: 5'-CAACTGAGTTGTATTGGTACCACTTCC-3' | (SEQ ID NO: 2882)<br>(SEQ ID NO: 4896)<br>(SEQ ID NO: 6910) |
| LDHA-2015 | 5'-CUGAGUUGUAUUGGUACCACUUCca-3'<br>3'-UUGACUCAACAUAACCAUGGUGAAGGU-5'<br>Target: 5'-AACTGAGTTGTATTGGTACCACTTCCA-3' | (SEQ ID NO: 2883)<br>(SEQ ID NO: 4897)<br>(SEQ ID NO: 6911) |
| LDHA-2016 | 5'-UGAGUUGUAUUGGUACCACUUCCat-3'<br>3'-UGACUCAACAUAACCAUGGUGAAGGUA-5'<br>Target: 5'-ACTGAGTTGTATTGGTACCACTTCCAT-3' | (SEQ ID NO: 2884)<br>(SEQ ID NO: 4898)<br>(SEQ ID NO: 6912) |
| LDHA-2017 | 5'-GAGUUGUAUUGGUACCACUUCCAtt-3'<br>3'-GACUCAACAUAACCAUGGUGAAGGUAA-5'<br>Target: 5'-CTGAGTTGTATTGGTACCACTTCCATT-3' | (SEQ ID NO: 2885)<br>(SEQ ID NO: 4899)<br>(SEQ ID NO: 6913) |

TABLE 12-continued

Additional Selected Human Anti-Lactate Dehydrogenase DsiRNA Agents (Asymmetrics)

```
              5'-AGUUGUAUUGGUACCACUUCCAUtg-3'       (SEQ ID NO: 2886)
              3'-ACUCAACAUAACCAUGGUGAAGGUAAC-5'     (SEQ ID NO: 4900)
LDHA-2018 Target: 5'-TGAGTTGTATTGGTACCACTTCCATTG-3' (SEQ ID NO: 6914)

5'-GUUGUAUUGGUACCACUUCCAUUgt-3'      (SEQ ID NO: 2887)
              3'-CUCAACAUAACCAUGGUGAAGGUAACA-5'    (SEQ ID NO: 4901)
LDHA-2019 Target: 5'-GAGTTGTATTGGTACCACTTCCATTGT-3' (SEQ ID NO: 6915)

5'-UUGUAUUGGUACCACUUCCAUUGta-3'      (SEQ ID NO: 2888)
              3'-UCAACAUAACCAUGGUGAAGGUAACAU-5'    (SEQ ID NO: 4902)
LDHA-2020 Target: 5'-AGTTGTATTGGTACCACTTCCATTGTA-3' (SEQ ID NO: 6916)

5'-UGUAUUGGUACCACUUCCAUUGUaa-3'      (SEQ ID NO: 2889)
              3'-CAACAUAACCAUGGUGAAGGUAACAUU-5'    (SEQ ID NO: 4903)
LDHA-2021 Target: 5'-GTTGTATTGGTACCACTTCCATTGTAA-3' (SEQ ID NO: 6917)

5'-GUAUUGGUACCACUUCCAUUGUAag-3'      (SEQ ID NO: 2890)
              3'-AACAUAACCAUGGUGAAGGUAACAUUC-5'    (SEQ ID NO: 4904)
LDHA-2022 Target: 5'-TTGTATTGGTACCACTTCCATTGTAAG-3' (SEQ ID NO: 6918)

5'-UAUUGGUACCACUUCCAUUGUAAgt-3'      (SEQ ID NO: 2891)
              3'-ACAUAACCAUGGUGAAGGUAACAUUCA-5'    (SEQ ID NO: 4905)
LDHA-2023 Target: 5'-TGTATTGGTACCACTTCCATTGTAAGT-3' (SEQ ID NO: 6919)

5'-AUUGGUACCACUUCCAUUGUAAGtc-3'      (SEQ ID NO: 2892)
              3'-CAUAACCAUGGUGAAGGUAACAUUCAG-5'    (SEQ ID NO: 4906)
LDHA-2024 Target: 5'-GTATTGGTACCACTTCCATTGTAAGTC-3' (SEQ ID NO: 6920)

5'-UUGGUACCACUUCCAUUGUAAGUcc-3'      (SEQ ID NO: 2893)
              3'-AUAACCAUGGUGAAGGUAACAUUCAGG-5'    (SEQ ID NO: 4907)
LDHA-2025 Target: 5'-TATTGGTACCACTTCCATTGTAAGTCC-3' (SEQ ID NO: 6921)

5'-UGGUACCACUUCCAUUGUAAGUCcc-3'      (SEQ ID NO: 2894)
              3'-UAACCAUGGUGAAGGUAACAUUCAGGG-5'    (SEQ ID NO: 4908)
LDHA-2026 Target: 5'-ATTGGTACCACTTCCATTGTAAGTCCC-3' (SEQ ID NO: 6922)

5'-GGUACCACUUCCAUUGUAAGUCCca-3'      (SEQ ID NO: 2895)
              3'-AACCAUGGUGAAGGUAACAUUCAGGGU-5'    (SEQ ID NO: 4909)
LDHA-2027 Target: 5'-TTGGTACCACTTCCATTGTAAGTCCCA-3' (SEQ ID NO: 6923)

5'-GUACCACUUCCAUUGUAAGUCCCaa-3'      (SEQ ID NO: 2896)
              3'-ACCAUGGUGAAGGUAACAUUCAGGGUU-5'    (SEQ ID NO: 4910)
LDHA-2028 Target: 5'-TGGTACCACTTCCATTGTAAGTCCCAA-3' (SEQ ID NO: 6924)

5'-UACCACUUCCAUUGUAAGUCCCAaa-3'      (SEQ ID NO: 2897)
              3'-CCAUGGUGAAGGUAACAUUCAGGGUUU-5'    (SEQ ID NO: 4911)
LDHA-2029 Target: 5'-GGTACCACTTCCATTGTAAGTCCCAAA-3' (SEQ ID NO: 6925)

5'-ACCACUUCCAUUGUAAGUCCCAAag-3'      (SEQ ID NO: 2898)
              3'-CAUGGUGAAGGUAACAUUCAGGGUUUC-5'    (SEQ ID NO: 4912)
LDHA-2030 Target: 5'-GTACCACTTCCATTGTAAGTCCCAAAG-3' (SEQ ID NO: 6926)

5'-CCACUUCCAUUGUAAGUCCCAAAgt-3'      (SEQ ID NO: 2899)
              3'-AUGGUGAAGGUAACAUUCAGGGUUUCA-5'    (SEQ ID NO: 4913)
LDHA-2031 Target: 5'-TACCACTTCCATTGTAAGTCCCAAAGT-3' (SEQ ID NO: 6927)

5'-CACUUCCAUUGUAAGUCCCAAAGta-3'      (SEQ ID NO: 2900)
              3'-UGGUGAAGGUAACAUUCAGGGUUUCAU-5'    (SEQ ID NO: 4914)
LDHA-2032 Target: 5'-ACCACTTCCATTGTAAGTCCCAAAGTA-3' (SEQ ID NO: 6928)

5'-ACUUCCAUUGUAAGUCCCAAAGUat-3'      (SEQ ID NO: 2901)
              3'-GGUGAAGGUAACAUUCAGGGUUUCAUA-5'    (SEQ ID NO: 4915)
LDHA-2033 Target: 5'-CCACTTCCATTGTAAGTCCCAAAGTAT-3' (SEQ ID NO: 6929)

5'-CUUCCAUUGUAAGUCCCAAAGUAtt-3'      (SEQ ID NO: 2902)
              3'-GUGAAGGUAACAUUCAGGGUUUCAUAA-5'    (SEQ ID NO: 4916)
LDHA-2034 Target: 5'-CACTTCCATTGTAAGTCCCAAAGTATT-3' (SEQ ID NO: 6930)

5'-UUCCAUUGUAAGUCCCAAAGUAUta-3'      (SEQ ID NO: 2903)
              3'-UGAAGGUAACAUUCAGGGUUUCAUAAU-5'    (SEQ ID NO: 4917)
LDHA-2035 Target: 5'-ACTTCCATTGTAAGTCCCAAAGTATTA-3' (SEQ ID NO: 6931)

5'-UCCAUUGUAAGUCCCAAAGUAUUat-3'      (SEQ ID NO: 2904)
              3'-GAAGGUAACAUUCAGGGUUUCAUAAUA-5'    (SEQ ID NO: 4918)
LDHA-2036 Target: 5'-CTTCCATTGTAAGTCCCAAAGTATTAT-3' (SEQ ID NO: 6932)
```

TABLE 12-continued

Additional Selected Human Anti-Lactate Dehydrogenase DsiRNA Agents (Asymmetrics)

```
                5'-CCAUUGUAAGUCCCAAAGUAUUAUa-3'     (SEQ ID NO: 2905)
                3'-AAGGUAACAUUCAGGGUUUCAUAAUAU-5'    (SEQ ID NO: 4919)
LDHA-2037 Target: 5'-TTCCATTGTAAGTCCCAAAGTATTATA-3'   (SEQ ID NO: 6933)

5'-CAUUGUAAGUCCCAAAGUAUUAUat-3'     (SEQ ID NO: 2906)
                3'-AGGUAACAUUCAGGGUUUCAUAAUAUA-5'    (SEQ ID NO: 4920)
LDHA-2038 Target: 5'-TCCATTGTAAGTCCCAAAGTATTATAT-3'   (SEQ ID NO: 6934)

5'-AUUGUAAGUCCCAAAGUAUUAUAta-3'     (SEQ ID NO: 2907)
                3'-GGUAACAUUCAGGGUUUCAUAAUAUAU-5'    (SEQ ID NO: 4921)
LDHA-2039 Target: 5'-CCATTGTAAGTCCCAAAGTATTATATA-3'   (SEQ ID NO: 6935)

5'-UUGUAAGUCCCAAAGUAUUAUAUat-3'     (SEQ ID NO: 2908)
                3'-GUAACAUUCAGGGUUUCAUAAUAUAUA-5'    (SEQ ID NO: 4922)
LDHA-2040 Target: 5'-CATTGTAAGTCCCAAAGTATTATATAT-3'   (SEQ ID NO: 6936)

5'-UGUAAGUCCCAAAGUAUUAUAUAUtt-3'    (SEQ ID NO: 2909)
                3'-UAACAUUCAGGGUUUCAUAAUAUAUAA-5'    (SEQ ID NO: 4923)
LDHA-2041 Target: 5'-ATTGTAAGTCCCAAAGTATTATATATT-3'   (SEQ ID NO: 6937)

5'-GUAAGUCCCAAAGUAUUAUAUAUtt-3'     (SEQ ID NO: 2910)
                3'-AACAUUCAGGGUUUCAUAAUAUAUAAA-5'    (SEQ ID NO: 4924)
LDHA-2042 Target: 5'-TTGTAAGTCCCAAAGTATTATATATTT-3'   (SEQ ID NO: 6938)

5'-UAAGUCCCAAAGUAUUAUAUAUUtg-3'     (SEQ ID NO: 2911)
                3'-ACAUUCAGGGUUUCAUAAUAUAUAAAC-5'    (SEQ ID NO: 4925)
LDHA-2043 Target: 5'-TGTAAGTCCCAAAGTATTATATATTTG-3'   (SEQ ID NO: 6939)

5'-AAGUCCCAAAGUAUUAUAUAUUUga-3'     (SEQ ID NO: 2912)
                3'-CAUUCAGGGUUUCAUAAUAUAUAAACU-5'    (SEQ ID NO: 4926)
LDHA-2044 Target: 5'-GTAAGTCCCAAAGTATTATATATTTGA-3'   (SEQ ID NO: 6940)

5'-AGUCCCAAAGUAUUAUAUAUUUGat-3'     (SEQ ID NO: 2913)
                3'-AUUCAGGGUUUCAUAAUAUAUAAACUA-5'    (SEQ ID NO: 4927)
LDHA-2045 Target: 5'-TAAGTCCCAAAGTATTATATATTTGAT-3'   (SEQ ID NO: 6941)

5'-GUCCCAAAGUAUUAUAUAUUUGAta-3'     (SEQ ID NO: 2914)
                3'-UUCAGGGUUUCAUAAUAUAUAAACUAU-5'    (SEQ ID NO: 4928)
LDHA-2046 Target: 5'-AAGTCCCAAAGTATTATATATTTGATA-3'   (SEQ ID NO: 6942)

5'-UCCCAAAGUAUUAUAUAUUUGAUaa-3'     (SEQ ID NO: 2915)
                3'-UCAGGGUUUCAUAAUAUAUAAACUAUU-5'    (SEQ ID NO: 4929)
LDHA-2047 Target: 5'-AGTCCCAAAGTATTATATATTTGATAA-3'   (SEQ ID NO: 6943)

5'-CCCAAAGUAUUAUAUAUUUGAUAat-3'     (SEQ ID NO: 2916)
                3'-CAGGGUUUCAUAAUAUAUAAACUAUUA-5'    (SEQ ID NO: 4930)
LDHA-2048 Target: 5'-GTCCCAAAGTATTATATATTTGATAAT-3'   (SEQ ID NO: 6944)

5'-CCAAAGUAUUAUAUAUUUGAUAAta-3'     (SEQ ID NO: 2917)
                3'-AGGGUUUCAUAAUAUAUAAACUAUUAU-5'    (SEQ ID NO: 4931)
LDHA-2049 Target: 5'-TCCCAAAGTATTATATATTTGATAATA-3'   (SEQ ID NO: 6945)

5'-CAAAGUAUUAUAUAUUUGAUAAUaa-3'     (SEQ ID NO: 2918)
                3'-GGGUUUCAUAAUAUAUAAACUAUUAUU-5'    (SEQ ID NO: 4932)
LDHA-2050 Target: 5'-CCCAAAGTATTATATATTTGATAATAA-3'   (SEQ ID NO: 6946)

5'-AAAGUAUUAUAUAUUUGAUAAUAat-3'     (SEQ ID NO: 2919)
                3'-GGUUUCAUAAUAUAUAAACUAUUAUUA-5'    (SEQ ID NO: 4933)
LDHA-2051 Target: 5'-CCAAAGTATTATATATTTGATAATAAT-3'   (SEQ ID NO: 6947)

5'-AAGUAUUAUAUAUUUGAUAAUAAtg-3'     (SEQ ID NO: 2920)
                3'-GUUUCAUAAUAUAUAAACUAUUAUUAC-5'    (SEQ ID NO: 4934)
LDHA-2052 Target: 5'-CAAAGTATTATATATTTGATAATAATG-3'   (SEQ ID NO: 6948)

5'-AGUAUUAUAUAUUUGAUAAUAAUgc-3'     (SEQ ID NO: 2921)
                3'-UUUCAUAAUAUAUAAACUAUUAUUACG-5'    (SEQ ID NO: 4935)
LDHA-2053 Target: 5'-AAAGTATTATATATTTGATAATAATGC-3'   (SEQ ID NO: 6949)

5'-GUAUUAUAUAUUUGAUAAUAAUGct-3'     (SEQ ID NO: 2922)
                3'-UUCAUAAUAUAUAAACUAUUAUUACGA-5'    (SEQ ID NO: 4936)
LDHA-2054 Target: 5'-AAGTATTATATATTTGATAATAATGCT-3'   (SEQ ID NO: 6950)

5'-UAUUAUAUAUUUGAUAAUAAUGCta-3'     (SEQ ID NO: 2923)
                3'-UCAUAAUAUAUAAACUAUUAUUACGAU-5'    (SEQ ID NO: 4937)
LDHA-2055 Target: 5'-AGTATTATATATTTGATAATAATGCTA-3'   (SEQ ID NO: 6951)
```

TABLE 12-continued

Additional Selected Human Anti-Lactate Dehydrogenase DsiRNA Agents (Asymmetrics)

| | | |
|---|---|---|
| LDHA-2056 | 5'-A<u>U</u>AUAUA<u>U</u>UUGA<u>U</u>A<u>AU</u>AAUGCUaa-3'<br>3'-<u>C</u>A<u>UA</u>AUAUAUAAA<u>C</u>U<u>A</u>UUA<u>U</u>UACG<u>A</u>UU-5'<br>Target: 5'-GTATTATATATTTGATAATAATGCTAA-3' | (SEQ ID NO: 2924)<br>(SEQ ID NO: 4938)<br>(SEQ ID NO: 6952) |
| LDHA-2057 | 5'-U<u>U</u>AUAU<u>A</u>UUUGA<u>U</u>A<u>AU</u>AAUGCUAat-3'<br>3'-<u>A</u>U<u>A</u>AUAUAUAAAC<u>U</u>A<u>U</u>UA<u>U</u>UACG<u>A</u>UUA-5'<br>Target: 5'-TATTATATATTTGATAATAATGCTAAT-3' | (SEQ ID NO: 2925)<br>(SEQ ID NO: 4939)<br>(SEQ ID NO: 6953) |
| LDHA-2058 | 5'-U<u>A</u>U<u>A</u>UAUUUGA<u>U</u>A<u>AU</u>AAUGCUAAtc-3'<br>3'-<u>U</u>A<u>A</u>U<u>A</u>UAUAAAC<u>U</u>A<u>U</u>UA<u>U</u>UACGA<u>U</u>UAG-5'<br>Target: 5'-ATTATATATTTGATAATAATGCTAATC-3' | (SEQ ID NO: 2926)<br>(SEQ ID NO: 4940)<br>(SEQ ID NO: 6954) |
| LDHA-2059 | 5'-A<u>U</u>AUAUUUGA<u>U</u>A<u>AU</u>AAUGCUAAUca-3'<br>3'-<u>A</u>AU<u>A</u>UAUAAAC<u>U</u>A<u>U</u>UA<u>U</u>UACGA<u>U</u>UAGU-5'<br>Target: 5'-TTATATATTTGATAATAATGCTAATCA-3' | (SEQ ID NO: 2927)<br>(SEQ ID NO: 4941)<br>(SEQ ID NO: 6955) |
| LDHA-2060 | 5'-U<u>A</u>UAU<u>U</u>UGA<u>U</u>AA<u>U</u>A<u>A</u>UGCUAAUCat-3'<br>3'-<u>A</u>U<u>A</u>U<u>A</u>UAAAC<u>U</u>A<u>U</u>UA<u>U</u>UACGA<u>U</u>UAGUA-5'<br>Target: 5'-TATATATTTGATAATAATGCTAATCAT-3' | (SEQ ID NO: 2928)<br>(SEQ ID NO: 4942)<br>(SEQ ID NO: 6956) |
| LDHA-2061 | 5'-A<u>U</u>AU<u>U</u>UGA<u>U</u>AA<u>U</u>A<u>AU</u>GCUAAUCAta-3'<br>3'-<u>U</u>A<u>U</u>A<u>U</u>AAACUA<u>U</u>UA<u>U</u>UACGA<u>U</u>UAGUAU-5'<br>Target: 5'-ATATATTTGATAATAATGCTAATCATA-3' | (SEQ ID NO: 2929)<br>(SEQ ID NO: 4943)<br>(SEQ ID NO: 6957) |
| LDHA-2062 | 5'-U<u>A</u>U<u>U</u>UGA<u>U</u>AA<u>U</u>A<u>A</u>UG<u>C</u>UAAUCAUaa-3'<br>3'-<u>A</u>U<u>A</u>U<u>A</u>AACUA<u>U</u>UA<u>U</u>U<u>A</u>CGA<u>U</u>UAGUA<u>U</u>U-5'<br>Target: 5'-TATATTTGATAATAATGCTAATCATAA-3' | (SEQ ID NO: 2930)<br>(SEQ ID NO: 4944)<br>(SEQ ID NO: 6958) |
| LDHA-2063 | 5'-A<u>U</u>UUGA<u>U</u>AA<u>U</u>A<u>A</u>UG<u>C</u>UAAUCAUAat-3'<br>3'-<u>U</u>A<u>U</u>A<u>A</u>ACUA<u>U</u>UA<u>U</u>UACGA<u>U</u>UAGUA<u>U</u>UA-5'<br>Target: 5'-ATATTTGATAATAATGCTAATCATAAT-3' | (SEQ ID NO: 2931)<br>(SEQ ID NO: 4945)<br>(SEQ ID NO: 6959) |
| LDHA-2064 | 5'-U<u>U</u>UGA<u>U</u>AA<u>U</u>A<u>A</u>UG<u>C</u>UAAUCAUAAtt-3'<br>3'-<u>A</u>U<u>A</u>AACUA<u>U</u>UA<u>U</u>UACGA<u>U</u>UAGUA<u>U</u>UAA-5'<br>Target: 5'-TATTTGATAATAATGCTAATCATAATT-3' | (SEQ ID NO: 2932)<br>(SEQ ID NO: 4946)<br>(SEQ ID NO: 6960) |
| LDHA-2065 | 5'-U<u>U</u>GA<u>U</u>AA<u>U</u>AA<u>U</u>G<u>C</u>UA<u>A</u>UCAUAAUtg-3'<br>3'-<u>U</u>A<u>A</u>ACUA<u>U</u>UA<u>U</u>UACG<u>A</u>UUAGUA<u>U</u>UAAC-5'<br>Target: 5'-ATTTGATAATAATGCTAATCATAATTG-3' | (SEQ ID NO: 2933)<br>(SEQ ID NO: 4947)<br>(SEQ ID NO: 6961) |
| LDHA-2066 | 5'-U<u>G</u>A<u>U</u>AA<u>U</u>AA<u>U</u>GCUA<u>A</u>UCAUAAUUgg-3'<br>3'-<u>A</u>A<u>A</u>CUA<u>U</u>UA<u>U</u>UACG<u>A</u>UUAGUA<u>U</u>UAACC-5'<br>Target: 5'-TTTGATAATAATGCTAATCATAATTGG-3' | (SEQ ID NO: 2934)<br>(SEQ ID NO: 4948)<br>(SEQ ID NO: 6962) |
| LDHA-2067 | 5'-G<u>A</u>UAA<u>U</u>AA<u>U</u>GCUA<u>A</u>U<u>C</u>AUAAUUGga-3'<br>3'-<u>A</u>A<u>C</u>UA<u>U</u>UA<u>U</u>UACG<u>A</u>UUAGUA<u>U</u>UAACC<u>U</u>-5'<br>Target: 5'-TTGATAATAATGCTAATCATAATTGGA-3' | (SEQ ID NO: 2935)<br>(SEQ ID NO: 4949)<br>(SEQ ID NO: 6963) |
| LDHA-2068 | 5'-A<u>U</u>A<u>A</u>UAA<u>U</u>GCUA<u>A</u>U<u>C</u>AUAAUUGGaa-3'<br>3'-<u>A</u>C<u>U</u>A<u>U</u>UA<u>U</u>UACGA<u>U</u>U<u>A</u>GUA<u>U</u>UAACC<u>U</u>U-5'<br>Target: 5'-TGATAATAATGCTAATCATAATTGGAA-3' | (SEQ ID NO: 2936)<br>(SEQ ID NO: 4950)<br>(SEQ ID NO: 6964) |
| LDHA-2069 | 5'-U<u>A</u>A<u>U</u>AAUGCUAAU<u>C</u>AUAAUUGGAaa-3'<br>3'-<u>C</u>U<u>A</u>UUA<u>U</u>UACGA<u>U</u>UAGUA<u>U</u>UAACC<u>U</u>UU-5'<br>Target: 5'-GATAATAATGCTAATCATAATTGGAAA-3' | (SEQ ID NO: 2937)<br>(SEQ ID NO: 4951)<br>(SEQ ID NO: 6965) |
| LDHA-2070 | 5'-A<u>A</u>U<u>A</u>AUGCUAAU<u>C</u>A<u>U</u>AAUUGGAAag-3'<br>3'-<u>U</u>A<u>U</u>UA<u>U</u>UACGAUUAG<u>U</u>A<u>U</u>UAACC<u>U</u>UUC-5'<br>Target: 5'-ATAATAATGCTAATCATAATTGGAAAG-3' | (SEQ ID NO: 2938)<br>(SEQ ID NO: 4952)<br>(SEQ ID NO: 6966) |
| LDHA-2071 | 5'-A<u>U</u>A<u>A</u>UGCUAAUCA<u>U</u>A<u>A</u>UUGGAAAgt-3'<br>3'-<u>A</u>U<u>U</u>A<u>U</u>UACGAUUAG<u>U</u>A<u>U</u>UAACC<u>U</u>UUCA-5'<br>Target: 5'-TAATAATGCTAATCATAATTGGAAAGT-3' | (SEQ ID NO: 2939)<br>(SEQ ID NO: 4953)<br>(SEQ ID NO: 6967) |
| LDHA-2072 | 5'-U<u>A</u>A<u>U</u>GCUAAUCA<u>U</u>A<u>A</u>UUGGAAAGta-3'<br>3'-<u>U</u>U<u>A</u>UUACGAUUAGUA<u>U</u>UAACC<u>U</u>UUC<u>A</u>U-5'<br>Target: 5'-AATAATGCTAATCATAATTGGAAAGTA-3' | (SEQ ID NO: 2940)<br>(SEQ ID NO: 4954)<br>(SEQ ID NO: 6968) |
| LDHA-2073 | 5'-A<u>A</u>UGCUAAUCA<u>U</u>A<u>AU</u>UGGAAAGUaa-3'<br>3'-<u>U</u>A<u>U</u>UACGAUUAGUA<u>U</u>UAACC<u>U</u>UUC<u>A</u>UU-5'<br>Target: 5'-ATAATGCTAATCATAATTGGAAAGTAA-3' | (SEQ ID NO: 2941)<br>(SEQ ID NO: 4955)<br>(SEQ ID NO: 6969) |
| LDHA-2074 | 5'-A<u>U</u>G<u>C</u>UAAUCAUA<u>A</u>U<u>U</u>GGAAAGUac-3'<br>3'-<u>A</u>U<u>U</u>A<u>C</u>GAUUAGUA<u>U</u>UA<u>A</u>CCUUUC<u>A</u>UUG-5'<br>Target: 5'-TAATGCTAATCATAATTGGAAAGTAAC-3' | (SEQ ID NO: 2942)<br>(SEQ ID NO: 4956)<br>(SEQ ID NO: 6970) |

TABLE 12-continued

Additional Selected Human Anti-Lactate Dehydrogenase DsiRNA Agents (Asymmetrics)

| | | |
|---|---|---|
| LDHA-2075 | 5'-UGCUAAUCAUAAUUGGAAAGUAAca-3'<br>3'-UUACGAUUAGUAUUAACCUUUCAUUGU-5'<br>Target: 5'-AATGCTAATCATAATTGGAAAGTAACA-3' | (SEQ ID NO: 2943)<br>(SEQ ID NO: 4957)<br>(SEQ ID NO: 6971) |
| LDHA-2076 | 5'-GCUAAUCAUAAUUGGAAAGUAACat-3'<br>3'-UACGAUUAGUAUUAACCUUUCAUUGUA-5'<br>Target: 5'-ATGCTAATCATAATTGGAAAGTAACAT-3' | (SEQ ID NO: 2944)<br>(SEQ ID NO: 4958)<br>(SEQ ID NO: 6972) |
| LDHA-2077 | 5'-CUAAUCAUAAUUGGAAAGUAACAtt-3'<br>3'-ACGAUUAGUAUUAACCUUUCAUUGUAA-5'<br>Target: 5'-TGCTAATCATAATTGGAAAGTAACATT-3' | (SEQ ID NO: 2945)<br>(SEQ ID NO: 4959)<br>(SEQ ID NO: 6973) |
| LDHA-2078 | 5'-UAAUCAUAAUUGGAAAGUAACAUtc-3'<br>3'-CGAUUAGUAUUAACCUUUCAUUGUAAG-5'<br>Target: 5'-GCTAATCATAATTGGAAAGTAACATTC-3' | (SEQ ID NO: 2946)<br>(SEQ ID NO: 4960)<br>(SEQ ID NO: 6974) |
| LDHA-2079 | 5'-AAUCAUAAUUGGAAAGUAACAUUct-3'<br>3'-GAUUAGUAUUAACCUUUCAUUGUAAGA-5'<br>Target: 5'-CTAATCATAATTGGAAAGTAACATTCT-3' | (SEQ ID NO: 2947)<br>(SEQ ID NO: 4961)<br>(SEQ ID NO: 6975) |
| LDHA-2080 | 5'-AUCAUAAUUGGAAAGUAACAUUCta-3'<br>3'-AUUAGUAUUAACCUUUCAUUGUAAGAU-5'<br>Target: 5'-TAATCATAATTGGAAAGTAACATTCTA-3' | (SEQ ID NO: 2948)<br>(SEQ ID NO: 4962)<br>(SEQ ID NO: 6976) |
| LDHA-2081 | 5'-UCAUAAUUGGAAAGUAACAUUCUat-3'<br>3'-UUAGUAUUAACCUUUCAUUGUAAGAUA-5'<br>Target: 5'-AATCATAATTGGAAAGTAACATTCTAT-3' | (SEQ ID NO: 2949)<br>(SEQ ID NO: 4963)<br>(SEQ ID NO: 6977) |
| LDHA-2082 | 5'-CAUAAUUGGAAAGUAACAUUCUAta-3'<br>3'-UAGUAUUAACCUUUCAUUGUAAGAUAU-5'<br>Target: 5'-ATCATAATTGGAAAGTAACATTCTATA-3' | (SEQ ID NO: 2950)<br>(SEQ ID NO: 4964)<br>(SEQ ID NO: 6978) |
| LDHA-2083 | 5'-AUAAUUGGAAAGUAACAUUCUAUat-3'<br>3'-AGUAUUAACCUUUCAUUGUAAGAUAUA-5'<br>Target: 5'-TCATAATTGGAAAGTAACATTCTATAT-3' | (SEQ ID NO: 2951)<br>(SEQ ID NO: 4965)<br>(SEQ ID NO: 6979) |
| LDHA-2084 | 5'-UAAUUGGAAAGUAACAUUCUAUAtg-3'<br>3'-GUAUUAACCUUUCAUUGUAAGAUAUAC-5'<br>Target: 5'-CATAATTGGAAAGTAACATTCTATATG-3' | (SEQ ID NO: 2952)<br>(SEQ ID NO: 4966)<br>(SEQ ID NO: 6980) |
| LDHA-2085 | 5'-AAUUGGAAAGUAACAUUCUAUAUgt-3'<br>3'-UAUUAACCUUUCAUUGUAAGAUAUACA-5'<br>Target: 5'-ATAATTGGAAAGTAACATTCTATATGT-3' | (SEQ ID NO: 2953)<br>(SEQ ID NO: 4967)<br>(SEQ ID NO: 6981) |
| LDHA-2086 | 5'-AUUGGAAAGUAACAUUCUAUAUGta-3'<br>3'-AUUAACCUUUCAUUGUAAGAUAUACAU-5'<br>Target: 5'-TAATTGGAAAGTAACATTCTATATGTA-3' | (SEQ ID NO: 2954)<br>(SEQ ID NO: 4968)<br>(SEQ ID NO: 6982) |
| LDHA-2087 | 5'-UUGGAAAGUAACAUUCUAUAUGUaa-3'<br>3'-UUAACCUUUCAUUGUAAGAUAUACAUU-5'<br>Target: 5'-AATTGGAAAGTAACATTCTATATGTAA-3' | (SEQ ID NO: 2955)<br>(SEQ ID NO: 4969)<br>(SEQ ID NO: 6983) |
| LDHA-2088 | 5'-UGGAAAGUAACAUUCUAUAUGUAaa-3'<br>3'-UAACCUUUCAUUGUAAGAUAUACAUUU-5'<br>Target: 5'-ATTGGAAAGTAACATTCTATATGTAAA-3' | (SEQ ID NO: 2956)<br>(SEQ ID NO: 4970)<br>(SEQ ID NO: 6984) |
| LDHA-2089 | 5'-GGAAAGUAACAUUCUAUAUGUAAat-3'<br>3'-AACCUUUCAUUGUAAGAUAUACAUUUA-5'<br>Target: 5'-TTGGAAAGTAACATTCTATATGTAAAT-3' | (SEQ ID NO: 2957)<br>(SEQ ID NO: 4971)<br>(SEQ ID NO: 6985) |
| LDHA-2090 | 5'-GAAAGUAACAUUCUAUAUGUAAAtg-3'<br>3'-ACCUUUCAUUGUAAGAUAUACAUUUAC-5'<br>Target: 5'-TGGAAAGTAACATTCTATATGTAAATG-3' | (SEQ ID NO: 2958)<br>(SEQ ID NO: 4972)<br>(SEQ ID NO: 6986) |
| LDHA-2091 | 5'-AAAGUAACAUUCUAUAUGUAAAUgt-3'<br>3'-CCUUUCAUUGUAAGAUAUACAUUUACA-5'<br>Target: 5'-GGAAAGTAACATTCTATATGTAAATGT-3' | (SEQ ID NO: 2959)<br>(SEQ ID NO: 4973)<br>(SEQ ID NO: 6987) |
| LDHA-2092 | 5'-AAGUAACAUUCUAUAUGUAAAUGta-3'<br>3'-CUUUCAUUGUAAGAUAUACAUUUACAU-5'<br>Target: 5'-GAAAGTAACATTCTATATGTAAATGTA-3' | (SEQ ID NO: 2960)<br>(SEQ ID NO: 4974)<br>(SEQ ID NO: 6988) |
| LDHA-2093 | 5'-AGUAACAUUCUAUAUGUAAAUGUaa-3'<br>3'-UUUCAUUGUAAGAUAUACAUUUACAUU-5'<br>Target: 5'-AAAGTAACATTCTATATGTAAATGTAA-3' | (SEQ ID NO: 2961)<br>(SEQ ID NO: 4975)<br>(SEQ ID NO: 6989) |

TABLE 12-continued

Additional Selected Human Anti-Lactate Dehydrogenase DsiRNA Agents (Asymmetrics)

| | | |
|---|---|---|
| LDHA-2094 | 5'-GUAACAUUCUAUAUGUAAAUGUAAaa-3'<br>3'-UUCAUUGUAAGAUAUACAUUUACAUUU-5'<br>Target: 5'-AAGTAACATTCTATATGTAAATGTAAA-3' | (SEQ ID NO: 2962)<br>(SEQ ID NO: 4976)<br>(SEQ ID NO: 6990) |
| LDHA-2095 | 5'-UAACAUUCUAUAUGUAAAUGUAAaa-3'<br>3'-UCAUUGUAAGAUAUACAUUUACAUUUU-5'<br>Target: 5'-AGTAACATTCTATATGTAAATGTAAAA-3' | (SEQ ID NO: 2963)<br>(SEQ ID NO: 4977)<br>(SEQ ID NO: 6991) |
| LDHA-2096 | 5'-AACAUUCUAUAUGUAAAUGUAAAat-3'<br>3'-CAUUGUAAGAUAUACAUUUACAUUUA-5'<br>Target: 5'-GTAACATTCTATATGTAAATGTAAAAT-3' | (SEQ ID NO: 2964)<br>(SEQ ID NO: 4978)<br>(SEQ ID NO: 6992) |
| LDHA-2097 | 5'-ACAUUCUAUAUGUAAAUGUAAAAtt-3'<br>3'-AUUGUAAGAUAUACAUUUACAUUUAA-5'<br>Target: 5'-TAACATTCTATATGTAAATGTAAAATT-3' | (SEQ ID NO: 2965)<br>(SEQ ID NO: 4979)<br>(SEQ ID NO: 6993) |
| LDHA-2098 | 5'-CAUUCUAUAUGUAAAUGUAAAAUtt-3'<br>3'-UUGUAAGAUAUACAUUUACAUUUUAAA-5'<br>Target: 5'-AACATTCTATATGTAAATGTAAAATTT-3' | (SEQ ID NO: 2966)<br>(SEQ ID NO: 4980)<br>(SEQ ID NO: 6994) |
| LDHA-2099 | 5'-AUUCUAUAUGUAAAUGUAAAAUUta-3'<br>3'-UGUAAGAUAUACAUUUACAUUUUAAAU-5'<br>Target: 5'-ACATTCTATATGTAAATGTAAAATTTA-3' | (SEQ ID NO: 2967)<br>(SEQ ID NO: 4981)<br>(SEQ ID NO: 6995) |
| LDHA-2100 | 5'-UUCUAUAUGUAAAUGUAAAAUUUat-3'<br>3'-GUAAGAUAUACAUUUACAUUUUAAAUA-5'<br>Target: 5'-CATTCTATATGTAAATGTAAAATTTAT-3' | (SEQ ID NO: 2968)<br>(SEQ ID NO: 4982)<br>(SEQ ID NO: 6996) |
| LDHA-2101 | 5'-UCUAUAUGUAAAUGUAAAAUUUAtt-3'<br>3'-UAAGAUAUACAUUUACAUUUUAAAUAA-5'<br>Target: 5'-ATTCTATATGTAAATGTAAAATTTATT-3' | (SEQ ID NO: 2969)<br>(SEQ ID NO: 4983)<br>(SEQ ID NO: 6997) |
| LDHA-2102 | 5'-CUAUAUGUAAAUGUAAAAUUUAUtt-3'<br>3'-AAGAUAUACAUUUACAUUUUAAAUAAA-5'<br>Target: 5'-TTCTATATGTAAATGTAAAATTTATTT-3' | (SEQ ID NO: 2970)<br>(SEQ ID NO: 4984)<br>(SEQ ID NO: 6998) |
| LDHA-2103 | 5'-UAUAUGUAAAUGUAAAAUUUAUUtg-3'<br>3'-AGAUAUACAUUUACAUUUUAAAUAAAC-5'<br>Target: 5'-TCTATATGTAAATGTAAAATTTATTTG-3' | (SEQ ID NO: 2971)<br>(SEQ ID NO: 4985)<br>(SEQ ID NO: 6999) |
| LDHA-2104 | 5'-AUAUGUAAAUGUAAAAUUUAUUUgc-3'<br>3'-GAUAUACAUUUACAUUUUAAAUAAACG-5'<br>Target: 5'-CTATATGTAAATGTAAAATTTATTTGC-3' | (SEQ ID NO: 2972)<br>(SEQ ID NO: 4986)<br>(SEQ ID NO: 7000) |
| LDHA-2105 | 5'-UAUGUAAAUGUAAAAUUUAUUUGcc-3'<br>3'-AUAUACAUUUACAUUUUAAAUAAACGG-5'<br>Target: 5'-TATATGTAAATGTAAAATTTATTTGCC-3' | (SEQ ID NO: 2973)<br>(SEQ ID NO: 4987)<br>(SEQ ID NO: 7001) |
| LDHA-2106 | 5'-AUGUAAAUGUAAAAUUUAUUUGCca-3'<br>3'-UAUACAUUUACAUUUUAAAUAAACGGU-5'<br>Target: 5'-ATATGTAAATGTAAAATTTATTTGCCA-3' | (SEQ ID NO: 2974)<br>(SEQ ID NO: 4988)<br>(SEQ ID NO: 7002) |
| LDHA-2107 | 5'-UGUAAAUGUAAAAUUUAUUUGCCaa-3'<br>3'-AUACAUUUACAUUUUAAAUAAACGGUU-5'<br>Target: 5'-TATGTAAATGTAAAATTTATTTGCCAA-3' | (SEQ ID NO: 2975)<br>(SEQ ID NO: 4989)<br>(SEQ ID NO: 7003) |
| LDHA-2108 | 5'-GUAAAUGUAAAAUUUAUUUGCCAac-3'<br>3'-UACAUUUACAUUUUAAAUAAACGGUUG-5'<br>Target: 5'-ATGTAAATGTAAAATTTATTTGCCAAC-3' | (SEQ ID NO: 2976)<br>(SEQ ID NO: 4990)<br>(SEQ ID NO: 7004) |
| LDHA-2109 | 5'-UAAAUGUAAAAUUUAUUUGCCAAct-3'<br>3'-ACAUUUACAUUUUAAAUAAACGGUUGA-5'<br>Target: 5'-TGTAAATGTAAAATTTATTTGCCAACT-3' | (SEQ ID NO: 2977)<br>(SEQ ID NO: 4991)<br>(SEQ ID NO: 7005) |
| LDHA-2110 | 5'-AAAUGUAAAAUUUAUUUGCCAACtg-3'<br>3'-CAUUUACAUUUUAAAUAAACGGUUGAC-5'<br>Target: 5'-GTAAATGTAAAATTTATTTGCCAACTG-3' | (SEQ ID NO: 2978)<br>(SEQ ID NO: 4992)<br>(SEQ ID NO: 7006) |
| LDHA-2111 | 5'-AAUGUAAAAUUUAUUUGCCAACUga-3'<br>3'-AUUUACAUUUUAAAUAAACGGUUGACU-5'<br>Target: 5'-TAAATGTAAAATTTATTTGCCAACTGA-3' | (SEQ ID NO: 2979)<br>(SEQ ID NO: 4993)<br>(SEQ ID NO: 7007) |
| LDHA-2112 | 5'-AUGUAAAAUUUAUUUGCCAACUGaa-3'<br>3'-UUUACAUUUUAAAUAAACGGUUGACUU-5'<br>Target: 5'-AAATGTAAAATTTATTTGCCAACTGAA-3' | (SEQ ID NO: 2980)<br>(SEQ ID NO: 4994)<br>(SEQ ID NO: 7008) |

TABLE 12-continued

Additional Selected Human Anti-Lactate Dehydrogenase DsiRNA Agents (Asymmetrics)

| | | |
|---|---|---|
| LDHA-2113 | 5'-UG<u>U</u>AAAAUUUAUUU<u>G</u>CCAACUGAat-3'<br>3'-<u>UUAC</u>AUUUUAAAUA<u>AA</u>CGGUUGA<u>CUUA</u>-5'<br>Target: 5'-AATGTAAAATTTATTTGCCAACTGAAT-3' | (SEQ ID NO: 2981)<br>(SEQ ID NO: 4995)<br>(SEQ ID NO: 7009) |
| LDHA-2114 | 5'-G<u>U</u>AAAAUUUAUUUGC<u>C</u>AACUGAAta-3'<br>3'-<u>UAC</u>AUUUUAAAUAA<u>AC</u>GGUUGAC<u>UUAU</u>-5'<br>Target: 5'-ATGTAAAATTTATTTGCCAACTGAATA-3' | (SEQ ID NO: 2982)<br>(SEQ ID NO: 4996)<br>(SEQ ID NO: 7010) |
| LDHA-2115 | 5'-U<u>AAA</u>AUUUAUUUGC<u>C</u>AACUGAAUat-3'<br>3'-<u>AC</u>AUUUUAAAUAA<u>AC</u>GGUUGACUUA<u>UA</u>-5'<br>Target: 5'-TGTAAAATTTATTTGCCAACTGAATAT-3' | (SEQ ID NO: 2983)<br>(SEQ ID NO: 4997)<br>(SEQ ID NO: 7011) |
| LDHA-2116 | 5'-<u>AAAA</u>UUUAUUUGCC<u>AA</u>CUGAAUAta-3'<br>3'-<u>C</u>AUUUUAAAUAAACGGUUGACUUA<u>UAU</u>-5'<br>Target: 5'-GTAAAATTTATTTGCCAACTGAATATA-3' | (SEQ ID NO: 2984)<br>(SEQ ID NO: 4998)<br>(SEQ ID NO: 7012) |
| LDHA-2117 | 5'-<u>AAA</u>UUUAUUUGCC<u>AA</u>CUGAAUAUag-3'<br>3'-<u>AUUU</u>AAAUAAACGGUUGACUUA<u>UAUC</u>-5'<br>Target: 5'-TAAAATTTATTTGCCAACTGAATATAG-3' | (SEQ ID NO: 2985)<br>(SEQ ID NO: 4999)<br>(SEQ ID NO: 7013) |
| LDHA-2118 | 5'-A<u>AUU</u>UAUUUGCCA<u>A</u>CUGAAUAUAgg-3'<br>3'-<u>UUUU</u>AAAUAAACGG<u>UU</u>GACUUAUA<u>UCC</u>-5'<br>Target: 5'-AAAATTTATTTGCCAACTGAATATAGG-3' | (SEQ ID NO: 2986)<br>(SEQ ID NO: 5000)<br>(SEQ ID NO: 7014) |
| LDHA-2119 | 5'-A<u>UUU</u>AUUUGCCAA<u>C</u>UGAAUAUAGgc-3'<br>3'-<u>UUUA</u>AAUAAACGGUU<u>GA</u>CUUAUA<u>UCCG</u>-5'<br>Target: 5'-AAATTTATTTGCCAACTGAATATAGGC-3' | (SEQ ID NO: 2987)<br>(SEQ ID NO: 5001)<br>(SEQ ID NO: 7015) |
| LDHA-2120 | 5'-<u>UUU</u>AUUUGCCAACU<u>GA</u>AUAUAGGca-3'<br>3'-<u>UUAA</u>AUAAACGGUUG<u>A</u>CUUAUAU<u>CCGU</u>-5'<br>Target: 5'-AATTTATTTGCCAACTGAATATAGGCA-3' | (SEQ ID NO: 2988)<br>(SEQ ID NO: 5002)<br>(SEQ ID NO: 7016) |
| LDHA-2121 | 5'-UU<u>A</u>UUGCCAACUGA<u>A</u>UAUAGGCaa-3'<br>3'-<u>UAA</u>AUAAACGGUUGA<u>C</u>UUAUAUCC<u>GUU</u>-5'<br>Target: 5'-ATTTATTTGCCAACTGAATATAGGCAA-3' | (SEQ ID NO: 2989)<br>(SEQ ID NO: 5003)<br>(SEQ ID NO: 7017) |
| LDHA-2122 | 5'-U<u>A</u>UUGCCAACUGA<u>AU</u>AUAGGCAat-3'<br>3'-<u>AAA</u>UAAACGGUUGA<u>C</u>UUAUAUCC<u>GUUA</u>-5'<br>Target: 5'-TTTATTTGCCAACTGAATATAGGCAAT-3' | (SEQ ID NO: 2990)<br>(SEQ ID NO: 5004)<br>(SEQ ID NO: 7018) |
| LDHA-2123 | 5'-<u>A</u>UUUGCCAACUGA<u>AU</u>AUAGGCAAtg-3'<br>3'-<u>AAU</u>AAACGGUUGAC<u>U</u>UAUAUCCG<u>UUAC</u>-5'<br>Target: 5'-TTATTTGCCAACTGAATATAGGCAATG-3' | (SEQ ID NO: 2991)<br>(SEQ ID NO: 5005)<br>(SEQ ID NO: 7019) |
| LDHA-2124 | 5'-U<u>UUG</u>CCAACUGAA<u>UA</u>UAGGCAAUga-3'<br>3'-<u>AUAA</u>ACGGUUGACUUA<u>U</u>AUCCGUUA<u>CU</u>-5'<br>Target: 5'-TATTTGCCAACTGAATATAGGCAATGA-3' | (SEQ ID NO: 2992)<br>(SEQ ID NO: 5006)<br>(SEQ ID NO: 7020) |
| LDHA-2125 | 5'-<u>UUG</u>CCAACUGAAU<u>AU</u>AGGCAAUGat-3'<br>3'-<u>UAAA</u>CGGUUGACUUAU<u>A</u>UCCGUUA<u>CUA</u>-5'<br>Target: 5'-ATTTGCCAACTGAATATAGGCAATGAT-3' | (SEQ ID NO: 2993)<br>(SEQ ID NO: 5007)<br>(SEQ ID NO: 7021) |
| LDHA-2126 | 5'-U<u>GCC</u>AACUGAAUA<u>U</u>AGGCAAUGAta-3'<br>3'-<u>AAAC</u>GGUUGACUUAUA<u>U</u>CCGUUAC<u>UAU</u>-5'<br>Target: 5'-TTTGCCAACTGAATATAGGCAATGATA-3' | (SEQ ID NO: 2994)<br>(SEQ ID NO: 5008)<br>(SEQ ID NO: 7022) |
| LDHA-2127 | 5'-<u>G</u>CCAACUGAAUAU<u>A</u>GGCAAUGAUag-3'<br>3'-<u>AACG</u>GUUGACUUAUA<u>U</u>CCGUUACU<u>AUC</u>-5'<br>Target: 5'-TTGCCAACTGAATATAGGCAATGATAG-3' | (SEQ ID NO: 2995)<br>(SEQ ID NO: 5009)<br>(SEQ ID NO: 7023) |
| LDHA-2128 | 5'-CC<u>A</u>ACUGAAUAUA<u>GG</u>CAAUGAUAgt-3'<br>3'-<u>ACG</u>GUUGACUUAU<u>A</u>UC<u>C</u>GUUACUA<u>UCA</u>-5'<br>Target: 5'-TGCCAACTGAATATAGGCAATGATAGT-3' | (SEQ ID NO: 2996)<br>(SEQ ID NO: 5010)<br>(SEQ ID NO: 7024) |
| LDHA-2129 | 5'-C<u>A</u>ACUGAAUAUAGG<u>C</u>AAUGAUAGtg-3'<br>3'-<u>C</u>GGUUGACUUAUAU<u>CC</u>GUUACUA<u>UCAC</u>-5'<br>Target: 5'-GCCAACTGAATATAGGCAATGATAGTG-3' | (SEQ ID NO: 2997)<br>(SEQ ID NO: 5011)<br>(SEQ ID NO: 7025) |
| LDHA-2130 | 5'-<u>A</u>ACUGAAUAUAGG<u>C</u>AAUGAUAGUgt-3'<br>3'-<u>GG</u>UUGACUUAUAUCC<u>G</u>UUACUAU<u>CACA</u>-5'<br>Target: 5'-CCAACTGAATATAGGCAATGATAGTGT-3' | (SEQ ID NO: 2998)<br>(SEQ ID NO: 5012)<br>(SEQ ID NO: 7026) |
| LDHA-2131 | 5'-<u>A</u>CUGAAUAUAGGC<u>AA</u>UGAUAGUGtg-3'<br>3'-<u>GUUG</u>ACUUAUAUCCG<u>U</u>UACUAUC<u>ACAC</u>-5'<br>Target: 5'-CAACTGAATATAGGCAATGATAGTGTG-3' | (SEQ ID NO: 2999)<br>(SEQ ID NO: 5013)<br>(SEQ ID NO: 7027) |

TABLE 12-continued

Additional Selected Human Anti-Lactate Dehydrogenase DsiRNA Agents (Asymmetrics)

|  |  |  |
|---|---|---|
| LDHA-2132 Target: | 5'-CUGAAUAUAGGCAAUGAUAGUGUGt-3'<br>3'-UUGACUUAUAUCCGUUACUAUCACACA-5'<br>5'-AACTGAATATAGGCAATGATAGTGTGT-3' | (SEQ ID NO: 3000)<br>(SEQ ID NO: 5014)<br>(SEQ ID NO: 7028) |
| LDHA-2133 Target: | 5'-UGAAUAUAGGCAAUGAUAGUGUGtc-3'<br>3'-UGACUUAUAUCCGUUACUAUCACACAG-5'<br>5'-ACTGAATATAGGCAATGATAGTGTGTC-3' | (SEQ ID NO: 3001)<br>(SEQ ID NO: 5015)<br>(SEQ ID NO: 7029) |
| LDHA-2134 Target: | 5'-GAAUAUAGGCAAUGAUAGUGUGUca-3'<br>3'-GACUUAUAUCCGUUACUAUCACACAGU-5'<br>5'-CTGAATATAGGCAATGATAGTGTGTCA-3' | (SEQ ID NO: 3002)<br>(SEQ ID NO: 5016)<br>(SEQ ID NO: 7030) |
| LDHA-2135 Target: | 5'-AAUAUAGGCAAUGAUAGUGUGUCac-3'<br>3'-ACUUAUAUCCGUUACUAUCACACAGUG-5'<br>5'-TGAATATAGGCAATGATAGTGTGTCAC-3' | (SEQ ID NO: 3003)<br>(SEQ ID NO: 5017)<br>(SEQ ID NO: 7031) |
| LDHA-2136 Target: | 5'-AUAUAGGCAAUGAUAGUGUGUCAct-3'<br>3'-CUUAUAUCCGUUACUAUCACACAGUGA-5'<br>5'-GAATATAGGCAATGATAGTGTGTCACT-3' | (SEQ ID NO: 3004)<br>(SEQ ID NO: 5018)<br>(SEQ ID NO: 7032) |
| LDHA-2137 Target: | 5'-UAUAGGCAAUGAUAGUGUGUCACta-3'<br>3'-UUUAUAUCCGUUACUAUCACACAGUGAU-5'<br>5'-AATATAGGCAATGATAGTGTGTCACTA-3' | (SEQ ID NO: 3005)<br>(SEQ ID NO: 5019)<br>(SEQ ID NO: 7033) |
| LDHA-2138 Target: | 5'-AUAGGCAAUGAUAGUGUGUCACUat-3'<br>3'-UAUAUCCGUUACUAUCACACAGUGAUA-5'<br>5'-ATATAGGCAATGATAGTGTGTCACTAT-3' | (SEQ ID NO: 3006)<br>(SEQ ID NO: 5020)<br>(SEQ ID NO: 7034) |
| LDHA-2139 Target: | 5'-UAGGCAAUGAUAGUGUGUCACUAta-3'<br>3'-AUAUCCGUUACUAUCACACAGUGAUAU-5'<br>5'-TATAGGCAATGATAGTGTGTCACTATA-3' | (SEQ ID NO: 3007)<br>(SEQ ID NO: 5021)<br>(SEQ ID NO: 7035) |
| LDHA-2140 Target: | 5'-AGGCAAUGAUAGUGUGUCACUAUag-3'<br>3'-UAUCCGUUACUAUCACACAGUGAUAUC-5'<br>5'-ATAGGCAATGATAGTGTGTCACTATAG-3' | (SEQ ID NO: 3008)<br>(SEQ ID NO: 5022)<br>(SEQ ID NO: 7036) |
| LDHA-2141 Target: | 5'-GGCAAUGAUAGUGUGUCACUAUAgg-3'<br>3'-AUCCGUUACUAUCACACAGUGAUAUCC-5'<br>5'-TAGGCAATGATAGTGTGTCACTATAGG-3' | (SEQ ID NO: 3009)<br>(SEQ ID NO: 5023)<br>(SEQ ID NO: 7037) |
| LDHA-2142 Target: | 5'-GCAAUGAUAGUGUGUCACUAUAGgg-3'<br>3'-UCCGUUACUAUCACACAGUGAUAUCCC-5'<br>5'-AGGCAATGATAGTGTGTCACTATAGGG-3' | (SEQ ID NO: 3010)<br>(SEQ ID NO: 5024)<br>(SEQ ID NO: 7038) |
| LDHA-2143 Target: | 5'-CAAUGAUAGUGUGUCACUAUAGGga-3'<br>3'-CCGUUACUAUCACACAGUGAUAUCCCU-5'<br>5'-GGCAATGATAGTGTGTCACTATAGGGA-3' | (SEQ ID NO: 3011)<br>(SEQ ID NO: 5025)<br>(SEQ ID NO: 7039) |
| LDHA-2144 Target: | 5'-AAUGAUAGUGUGUCACUAUAGGGaa-3'<br>3'-CGUUACUAUCACACAGUGAUAUCCCUU-5'<br>5'-GCAATGATAGTGTGTCACTATAGGGAA-3' | (SEQ ID NO: 3012)<br>(SEQ ID NO: 5026)<br>(SEQ ID NO: 7040) |
| LDHA-2145 Target: | 5'-AUGAUAGUGUGUCACUAUAGGGAac-3'<br>3'-GUUACUAUCACACAGUGAUAUCCCUUG-5'<br>5'-CAATGATAGTGTGTCACTATAGGGAAC-3' | (SEQ ID NO: 3013)<br>(SEQ ID NO: 5027)<br>(SEQ ID NO: 7041) |
| LDHA-2146 Target: | 5'-UGAUAGUGUGUCACUAUAGGGAAca-3'<br>3'-UUACUAUCACACAGUGAUAUCCCUUGU-5'<br>5'-AATGATAGTGTGTCACTATAGGGAACA-3' | (SEQ ID NO: 3014)<br>(SEQ ID NO: 5028)<br>(SEQ ID NO: 7042) |
| LDHA-2147 Target: | 5'-GAUAGUGUGUCACUAUAGGGAACac-3'<br>3'-UACUAUCACACAGUGAUAUCCCUUGUG-5'<br>5'-ATGATAGTGTGTCACTATAGGGAACAC-3' | (SEQ ID NO: 3015)<br>(SEQ ID NO: 5029)<br>(SEQ ID NO: 7043) |
| LDHA-2148 Target: | 5'-AUAGUGUGUCACUAUAGGGAACAca-3'<br>3'-ACUAUCACACAGUGAUAUCCCUUGUGU-5'<br>5'-TGATAGTGTGTCACTATAGGGAACACA-3' | (SEQ ID NO: 3016)<br>(SEQ ID NO: 5030)<br>(SEQ ID NO: 7044) |
| LDHA-2149 Target: | 5'-UAGUGUGUCACUAUAGGGAACACag-3'<br>3'-CUAUCACACAGUGAUAUCCCUUGUGUC-5'<br>5'-GATAGTGTGTCACTATAGGGAACACAG-3' | (SEQ ID NO: 3017)<br>(SEQ ID NO: 5031)<br>(SEQ ID NO: 7045) |
| LDHA-2150 Target: | 5'-AGUGUGUCACUAUAGGGAACACAga-3'<br>3'-UAUCACACAGUGAUAUCCCUUGUGUCU-5'<br>5'-ATAGTGTGTCACTATAGGGAACACAGA-3' | (SEQ ID NO: 3018)<br>(SEQ ID NO: 5032)<br>(SEQ ID NO: 7046) |

TABLE 12-continued

Additional Selected Human Anti-Lactate Dehydrogenase DsiRNA Agents (Asymmetrics)

```
                        5'-GUGUGUCACUAUAGGGAACACAGat-3'    (SEQ ID NO: 3019)
                        3'-AUCACACAGUGAUAUCCCUUGUGUCUA-5'  (SEQ ID NO: 5033)
LDHA-2151 Target:       5'-TAGTGTGTCACTATAGGGAACACAGAT-3'  (SEQ ID NO: 7047)

5'-UGUGUCACUAUAGGGAACACAGAtt-3'    (SEQ ID NO: 3020)
                        3'-UCACACAGUGAUAUCCCUUGUGUCUAA-5'  (SEQ ID NO: 5034)
LDHA-2152 Target:       5'-AGTGTGTCACTATAGGGAACACAGATT-3'  (SEQ ID NO: 7048)

5'-GUGUCACUAUAGGGAACACAGAUtt-3'    (SEQ ID NO: 3021)
                        3'-CACACAGUGAUAUCCCUUGUGUCUAAA-5'  (SEQ ID NO: 5035)
LDHA-2153 Target:       5'-GTGTGTCACTATAGGGAACACAGATTT-3'  (SEQ ID NO: 7049)

5'-UGUCACUAUAGGGAACACAGAUUtt-3'    (SEQ ID NO: 3022)
                        3'-ACACAGUGAUAUCCCUUGUGUCUAAAA-5'  (SEQ ID NO: 5036)
LDHA-2154 Target:       5'-TGTGTCACTATAGGGAACACAGATTTT-3'  (SEQ ID NO: 7050)

5'-GUCACUAUAGGGAACACAGAUUUtt-3'    (SEQ ID NO: 3023)
                        3'-CACAGUGAUAUCCCUUGUGUCUAAAAA-5'  (SEQ ID NO: 5037)
LDHA-2155 Target:       5'-GTGTCACTATAGGGAACACAGATTTTT-3'  (SEQ ID NO: 7051)

5'-UCACUAUAGGGAACACAGAUUUUtg-3'    (SEQ ID NO: 3024)
                        3'-ACAGUGAUAUCCCUUGUGUCUAAAAAC-5'  (SEQ ID NO: 5038)
LDHA-2156 Target:       5'-TGTCACTATAGGGAACACAGATTTTTG-3'  (SEQ ID NO: 7052)

5'-CACUAUAGGGAACACAGAUUUUUga-3'    (SEQ ID NO: 3025)
                        3'-CAGUGAUAUCCCUUGUGUCUAAAAACU-5'  (SEQ ID NO: 5039)
LDHA-2157 Target:       5'-GTCACTATAGGGAACACAGATTTTTGA-3'  (SEQ ID NO: 7053)

5'-ACUAUAGGGAACACAGAUUUUUGag-3'    (SEQ ID NO: 3026)
                        3'-AGUGAUAUCCCUUGUGUCUAAAAACUC-5'  (SEQ ID NO: 5040)
LDHA-2158 Target:       5'-TCACTATAGGGAACACAGATTTTTGAG-3'  (SEQ ID NO: 7054)

5'-CUAUAGGGAACACAGAUUUUUGAga-3'    (SEQ ID NO: 3027)
                        3'-GUGAUAUCCCUUGUGUCUAAAAACUCU-5'  (SEQ ID NO: 5041)
LDHA-2159 Target:       5'-CACTATAGGGAACACAGATTTTTGAGA-3'  (SEQ ID NO: 7055)

5'-UAUAGGGAACACAGAUUUUUGAGat-3'    (SEQ ID NO: 3028)
                        3'-UGAUAUCCCUUGUGUCUAAAAACUCUA-5'  (SEQ ID NO: 5042)
LDHA-2160 Target:       5'-ACTATAGGGAACACAGATTTTTGAGAT-3'  (SEQ ID NO: 7056)

5'-AUAGGGAACACAGAUUUUUGAGAtc-3'    (SEQ ID NO: 3029)
                        3'-GAUAUCCCUUGUGUCUAAAAACUCUAG-5'  (SEQ ID NO: 5043)
LDHA-2161 Target:       5'-CTATAGGGAACACAGATTTTTGAGATC-3'  (SEQ ID NO: 7057)

5'-UAGGGAACACAGAUUUUUGAGAUct-3'    (SEQ ID NO: 3030)
                        3'-AUAUCCCUUGUGUCUAAAAACUCUAGA-5'  (SEQ ID NO: 5044)
LDHA-2162 Target:       5'-TATAGGGAACACAGATTTTTGAGATCT-3'  (SEQ ID NO: 7058)

5'-AGGGAACACAGAUUUUUGAGAUCtt-3'    (SEQ ID NO: 3031)
                        3'-UAUCCCUUGUGUCUAAAAACUCUAGAA-5'  (SEQ ID NO: 5045)
LDHA-2163 Target:       5'-ATAGGGAACACAGATTTTTGAGATCTT-3'  (SEQ ID NO: 7059)

5'-GGGAACACAGAUUUUUGAGAUCUtg-3'    (SEQ ID NO: 3032)
                        3'-AUCCCUUGUGUCUAAAAACUCUAGAAC-5'  (SEQ ID NO: 5046)
LDHA-2164 Target:       5'-TAGGGAACACAGATTTTTGAGATCTTG-3'  (SEQ ID NO: 7060)

5'-GGAACACAGAUUUUUGAGAUCUUgt-3'    (SEQ ID NO: 3033)
                        3'-UCCCUUGUGUCUAAAAACUCUAGAACA-5'  (SEQ ID NO: 5047)
LDHA-2165 Target:       5'-AGGGAACACAGATTTTTGAGATCTTGT-3'  (SEQ ID NO: 7061)

5'-GAACACAGAUUUUUGAGAUCUUGtc-3'    (SEQ ID NO: 3034)
                        3'-CCCUUGUGUCUAAAAACUCUAGAACAG-5'  (SEQ ID NO: 5048)
LDHA-2166 Target:       5'-GGGAACACAGATTTTTGAGATCTTGTC-3'  (SEQ ID NO: 7062)

5'-AACACAGAUUUUUGAGAUCUUGUcc-3'    (SEQ ID NO: 3035)
                        3'-CCUUGUGUCUAAAAACUCUAGAACAGG-5'  (SEQ ID NO: 5049)
LDHA-2167 Target:       5'-GGAACACAGATTTTTGAGATCTTGTCC-3'  (SEQ ID NO: 7063)

5'-ACACAGAUUUUUGAGAUCUUGUCct-3'    (SEQ ID NO: 3036)
                        3'-CUUGUGUCUAAAAACUCUAGAACAGGA-5'  (SEQ ID NO: 5050)
LDHA-2168 Target:       5'-GAACACAGATTTTTGAGATCTTGTCCT-3'  (SEQ ID NO: 7064)

5'-CACAGAUUUUUGAGAUCUUGUCCtc-3'    (SEQ ID NO: 3037)
                        3'-UUGUGUCUAAAAACUCUAGAACAGGAG-5'  (SEQ ID NO: 5051)
LDHA-2169 Target:       5'-AACACAGATTTTTGAGATCTTGTCCTC-3'  (SEQ ID NO: 7065)
```

TABLE 12-continued

Additional Selected Human Anti-Lactate Dehydrogenase DsiRNA Agents (Asymmetrics)

|  |  |  |
| --- | --- | --- |
| LDHA-2170 | 5'-ACAGAUUUUGAGAUCUUGUCCUCt-3'<br>3'-UGUGUCUAAAAACUCUAGAACAGGAGA-5'<br>Target: 5'-ACACAGATTTTGAGATCTTGTCCTCT-3' | (SEQ ID NO: 3038)<br>(SEQ ID NO: 5052)<br>(SEQ ID NO: 7066) |
| LDHA-2171 | 5'-CAGAUUUUGAGAUCUUGUCCUCtg-3'<br>3'-GUGUCUAAAAACUCUAGAACAGGAGAC-5'<br>Target: 5'-CACAGATTTTGAGATCTTGTCCTCTG-3' | (SEQ ID NO: 3039)<br>(SEQ ID NO: 5053)<br>(SEQ ID NO: 7067) |
| LDHA-2172 | 5'-AGAUUUUGAGAUCUUGUCCUCUgg-3'<br>3'-UGUCUAAAAACUCUAGAACAGGAGACC-5'<br>Target: 5'-ACAGATTTTGAGATCTTGTCCTCTGG-3' | (SEQ ID NO: 3040)<br>(SEQ ID NO: 5054)<br>(SEQ ID NO: 7068) |
| LDHA-2173 | 5'-GAUUUUGAGAUCUUGUCCUCUGga-3'<br>3'-GUCUAAAAACUCUAGAACAGGAGACCU-5'<br>Target: 5'-CAGATTTTGAGATCTTGTCCTCTGGA-3' | (SEQ ID NO: 3041)<br>(SEQ ID NO: 5055)<br>(SEQ ID NO: 7069) |
| LDHA-2174 | 5'-AUUUUGAGAUCUUGUCCUCUGGaa-3'<br>3'-UCUAAAAACUCUAGAACAGGAGACCUU-5'<br>Target: 5'-AGATTTTGAGATCTTGTCCTCTGGAA-3' | (SEQ ID NO: 3042)<br>(SEQ ID NO: 5056)<br>(SEQ ID NO: 7070) |
| LDHA-2175 | 5'-UUUUGAGAUCUUGUCCUCUGGAag-3'<br>3'-CUAAAAACUCUAGAACAGGAGACCUUC-5'<br>Target: 5'-GATTTTGAGATCTTGTCCTCTGGAAG-3' | (SEQ ID NO: 3043)<br>(SEQ ID NO: 5057)<br>(SEQ ID NO: 7071) |
| LDHA-2176 | 5'-UUUGAGAUCUUGUCCUCUGGAAgc-3'<br>3'-UAAAAACUCUAGAACAGGAGACCUUCG-5'<br>Target: 5'-ATTTTGAGATCTTGTCCTCTGGAAGC-3' | (SEQ ID NO: 3044)<br>(SEQ ID NO: 5058)<br>(SEQ ID NO: 7072) |
| LDHA-2177 | 5'-UUUGAGAUCUUGUCCUCUGGAAGct-3'<br>3'-AAAAACUCUAGAACAGGAGACCUUCGA-5'<br>Target: 5'-TTTTTGAGATCTTGTCCTCTGGAAGCT-3' | (SEQ ID NO: 3045)<br>(SEQ ID NO: 5059)<br>(SEQ ID NO: 7073) |
| LDHA-2178 | 5'-UUGAGAUCUUGUCCUCUGGAAGCtg-3'<br>3'-AAAACUCUAGAACAGGAGACCUUCGAC-5'<br>Target: 5'-TTTTGAGATCTTGTCCTCTGGAAGCTG-3' | (SEQ ID NO: 3046)<br>(SEQ ID NO: 5060)<br>(SEQ ID NO: 7074) |
| LDHA-2179 | 5'-UGAGAUCUUGUCCUCUGGAAGCUgg-3'<br>3'-AAACUCUAGAACAGGAGACCUUCGACC-5'<br>Target: 5'-TTTGAGATCTTGTCCTCTGGAAGCTGG-3' | (SEQ ID NO: 3047)<br>(SEQ ID NO: 5061)<br>(SEQ ID NO: 7075) |
| LDHA-2180 | 5'-GAGAUCUUGUCCUCUGGAAGCUGgt-3'<br>3'-AACUCUAGAACAGGAGACCUUCGACCA-5'<br>Target: 5'-TTGAGATCTTGTCCTCTGGAAGCTGGT-3' | (SEQ ID NO: 3048)<br>(SEQ ID NO: 5062)<br>(SEQ ID NO: 7076) |
| LDHA-2181 | 5'-AGAUCUUGUCCUCUGGAAGCUGGta-3'<br>3'-ACUCUAGAACAGGAGACCUUCGACCAU-5'<br>Target: 5'-TGAGATCTTGTCCTCTGGAAGCTGGTA-3' | (SEQ ID NO: 3049)<br>(SEQ ID NO: 5063)<br>(SEQ ID NO: 7077) |
| LDHA-2182 | 5'-GAUCUUGUCCUCUGGAAGCUGGUaa-3'<br>3'-CUCUAGAACAGGAGACCUUCGACCAUU-5'<br>Target: 5'-GAGATCTTGTCCTCTGGAAGCTGGTAA-3' | (SEQ ID NO: 3050)<br>(SEQ ID NO: 5064)<br>(SEQ ID NO: 7078) |
| LDHA-2183 | 5'-AUCUUGUCCUCUGGAAGCUGGUAac-3'<br>3'-UCUAGAACAGGAGACCUUCGACCAUUG-5'<br>Target: 5'-AGATCTTGTCCTCTGGAAGCTGGTAAC-3' | (SEQ ID NO: 3051)<br>(SEQ ID NO: 5065)<br>(SEQ ID NO: 7079) |
| LDHA-2184 | 5'-UCUUGUCCUCUGGAAGCUGGUAAca-3'<br>3'-CUAGAACAGGAGACCUUCGACCAUUGU-5'<br>Target: 5'-GATCTTGTCCTCTGGAAGCTGGTAACA-3' | (SEQ ID NO: 3052)<br>(SEQ ID NO: 5066)<br>(SEQ ID NO: 7080) |
| LDHA-2185 | 5'-CUUGUCCUCUGGAAGCUGGUAACaa-3'<br>3'-UAGAACAGGAGACCUUCGACCAUUGUU-5'<br>Target: 5'-ATCTTGTCCTCTGGAAGCTGGTAACAA-3' | (SEQ ID NO: 3053)<br>(SEQ ID NO: 5067)<br>(SEQ ID NO: 7081) |
| LDHA-2186 | 5'-UUGUCCUCUGGAAGCUGGUAACAat-3'<br>3'-AGAACAGGAGACCUUCGACCAUUGUUA-5'<br>Target: 5'-TCTTGTCCTCTGGAAGCTGGTAACAAT-3' | (SEQ ID NO: 3054)<br>(SEQ ID NO: 5068)<br>(SEQ ID NO: 7082) |
| LDHA-2187 | 5'-UGUCCUCUGGAAGCUGGUAACAAtt-3'<br>3'-GAACAGGAGACCUUCGACCAUUGUUAA-5'<br>Target: 5'-CTTGTCCTCTGGAAGCTGGTAACAATT-3' | (SEQ ID NO: 3055)<br>(SEQ ID NO: 5069)<br>(SEQ ID NO: 7083) |
| LDHA-2188 | 5'-GUCCUCUGGAAGCUGGUAACAAUta-3'<br>3'-AACAGGAGACCUUCGACCAUUGUUAAU-5'<br>Target: 5'-TTGTCCTCTGGAAGCTGGTAACAATTA-3' | (SEQ ID NO: 3056)<br>(SEQ ID NO: 5070)<br>(SEQ ID NO: 7084) |

TABLE 12-continued

Additional Selected Human Anti-Lactate Dehydrogenase DsiRNA Agents (Asymmetrics)

```
                    5'-UCCUCUGGAAGCUGGUAACAAUUaa-3'      (SEQ ID NO: 3057)
                    3'-ACAGGAGACCUUCGACCAUUGUUAAUU-5'    (SEQ ID NO: 5071)
LDHA-2189 Target:   5'-TGTCCTCTGGAAGCTGGTAACAATTAA-3'    (SEQ ID NO: 7085)

5'-CCUCUGGAAGCUGGUAACAAUUAaa-3'      (SEQ ID NO: 3058)
                    3'-CAGGAGACCUUCGACCAUUGUUAAUUU-5'    (SEQ ID NO: 5072)
LDHA-2190 Target:   5'-GTCCTCTGGAAGCTGGTAACAATTAAA-3'    (SEQ ID NO: 7086)

5'-CUCUGGAAGCUGGUAACAAUUAAaa-3'      (SEQ ID NO: 3059)
                    3'-AGGAGACCUUCGACCAUUGUUAAUUUU-5'    (SEQ ID NO: 5073)
LDHA-2191 Target:   5'-TCCTCTGGAAGCTGGTAACAATTAAAA-3'    (SEQ ID NO: 7087)

5'-UCUGGAAGCUGGUAACAAUUAAAaa-3'      (SEQ ID NO: 3060)
                    3'-GGAGACCUUCGACCAUUGUUAAUUUUU-5'    (SEQ ID NO: 5074)
LDHA-2192 Target:   5'-CCTCTGGAAGCTGGTAACAATTAAAAA-3'    (SEQ ID NO: 7088)

5'-CUGGAAGCUGGUAACAAUUAAAAac-3'      (SEQ ID NO: 3061)
                    3'-GAGACCUUCGACCAUUGUUAAUUUUUG-5'    (SEQ ID NO: 5075)
LDHA-2193 Target:   5'-CTCTGGAAGCTGGTAACAATTAAAAAC-3'    (SEQ ID NO: 7089)

5'-UGGAAGCUGGUAACAAUUAAAAACa-3'      (SEQ ID NO: 3062)
                    3'-AGACCUUCGACCAUUGUUAAUUUUUGU-5'    (SEQ ID NO: 5076)
LDHA-2194 Target:   5'-TCTGGAAGCTGGTAACAATTAAAAACA-3'    (SEQ ID NO: 7090)

5'-GGAAGCUGGUAACAAUUAAAAACaa-3'      (SEQ ID NO: 3063)
                    3'-GACCUUCGACCAUUGUUAAUUUUUGUU-5'    (SEQ ID NO: 5077)
LDHA-2195 Target:   5'-CTGGAAGCTGGTAACAATTAAAAACAA-3'    (SEQ ID NO: 7091)

5'-GAAGCUGGUAACAAUUAAAAACAat-3'      (SEQ ID NO: 3064)
                    3'-ACCUUCGACCAUUGUUAAUUUUUGUUA-5'    (SEQ ID NO: 5078)
LDHA-2196 Target:   5'-TGGAAGCTGGTAACAATTAAAAACAAT-3'    (SEQ ID NO: 7092)

5'-AAGCUGGUAACAAUUAAAAACAAtc-3'      (SEQ ID NO: 3065)
                    3'-CCUUCGACCAUUGUUAAUUUUUGUUAG-5'    (SEQ ID NO: 5079)
LDHA-2197 Target:   5'-GGAAGCTGGTAACAATTAAAAACAATC-3'    (SEQ ID NO: 7093)

5'-AGCUGGUAACAAUUAAAAACAAUct-3'      (SEQ ID NO: 3066)
                    3'-CUUCGACCAUUGUUAAUUUUUGUUAGA-5'    (SEQ ID NO: 5080)
LDHA-2198 Target:   5'-GAAGCTGGTAACAATTAAAAACAATCT-3'    (SEQ ID NO: 7094)

5'-GCUGGUAACAAUUAAAAACAAUCtt-3'      (SEQ ID NO: 3067)
                    3'-UUCGACCAUUGUUAAUUUUUGUUAGAA-5'    (SEQ ID NO: 5081)
LDHA-2199 Target:   5'-AAGCTGGTAACAATTAAAAACAATCTT-3'    (SEQ ID NO: 7095)

5'-CUGGUAACAAUUAAAAACAAUCUta-3'      (SEQ ID NO: 3068)
                    3'-UCGACCAUUGUUAAUUUUUGUUAGAAU-5'    (SEQ ID NO: 5082)
LDHA-2200 Target:   5'-AGCTGGTAACAATTAAAAACAATCTTA-3'    (SEQ ID NO: 7096)

5'-UGGUAACAAUUAAAAACAAUCUUaa-3'      (SEQ ID NO: 3069)
                    3'-CGACCAUUGUUAAUUUUUGUUAGAAUU-5'    (SEQ ID NO: 5083)
LDHA-2201 Target:   5'-GCTGGTAACAATTAAAAACAATCTTAA-3'    (SEQ ID NO: 7097)

5'-GGUAACAAUUAAAAACAAUCUUAag-3'      (SEQ ID NO: 3070)
                    3'-GACCAUUGUUAAUUUUUGUUAGAAUUC-5'    (SEQ ID NO: 5084)
LDHA-2202 Target:   5'-CTGGTAACAATTAAAAACAATCTTAAG-3'    (SEQ ID NO: 7098)

5'-GUAACAAUUAAAAACAAUCUUAAgg-3'      (SEQ ID NO: 3071)
                    3'-ACCAUUGUUAAUUUUUGUUAGAAUUCC-5'    (SEQ ID NO: 5085)
LDHA-2203 Target:   5'-TGGTAACAATTAAAAACAATCTTAAGG-3'    (SEQ ID NO: 7099)

5'-UAACAAUUAAAAACAAUCUUAAGgc-3'      (SEQ ID NO: 3072)
                    3'-CCAUUGUUAAUUUUUGUUAGAAUUCCG-5'    (SEQ ID NO: 5086)
LDHA-2204 Target:   5'-GGTAACAATTAAAAACAATCTTAAGGC-3'    (SEQ ID NO: 7100)

5'-AACAAUUAAAAACAAUCUUAAGGca-3'      (SEQ ID NO: 3073)
                    3'-CAUUGUUAAUUUUUGUUAGAAUUCCGU-5'    (SEQ ID NO: 5087)
LDHA-2205 Target:   5'-GTAACAATTAAAAACAATCTTAAGGCA-3'    (SEQ ID NO: 7101)

5'-ACAAUUAAAAACAAUCUUAAGGCag-3'      (SEQ ID NO: 3074)
                    3'-AUUGUUAAUUUUUGUUAGAAUUCCGUC-5'    (SEQ ID NO: 5088)
LDHA-2206 Target:   5'-TAACAATTAAAAACAATCTTAAGGCAG-3'    (SEQ ID NO: 7102)

5'-CAAUUAAAAACAAUCUUAAGGCAgg-3'      (SEQ ID NO: 3075)
                    3'-UUGUUAAUUUUUGUUAGAAUUCCGUCC-5'    (SEQ ID NO: 5089)
LDHA-2207 Target:   5'-AACAATTAAAAACAATCTTAAGGCAGG-3'    (SEQ ID NO: 7103)
```

TABLE 12-continued

Additional Selected Human Anti-Lactate Dehydrogenase DsiRNA Agents (Asymmetrics)

|  |  |  |
|---|---|---|
| LDHA-2208 Target: | 5'-AAUUAAAAACAAUCUUAAGGCAGgg-3'<br>3'-UGUUAAUUUUUGUUAGAAUUCCGUCCC-5'<br>5'-ACAATTAAAAACAATCTTAAGGCAGGG-3' | (SEQ ID NO: 3076)<br>(SEQ ID NO: 5090)<br>(SEQ ID NO: 7104) |
| LDHA-2209 Target: | 5'-AUUAAAAACAAUCUUAAGGCAGGga-3'<br>3'-GUUAAUUUUUGUUAGAAUUCCGUCCCU-5'<br>5'-CAATTAAAAACAATCTTAAGGCAGGGA-3' | (SEQ ID NO: 3077)<br>(SEQ ID NO: 5091)<br>(SEQ ID NO: 7105) |
| LDHA-2210 Target: | 5'-UUAAAAACAAUCUUAAGGCAGGGaa-3'<br>3'-UUAAUUUUUGUUAGAAUUCCGUCCCUU-5'<br>5'-AATTAAAAACAATCTTAAGGCAGGGAA-3' | (SEQ ID NO: 3078)<br>(SEQ ID NO: 5092)<br>(SEQ ID NO: 7106) |
| LDHA-2211 Target: | 5'-UAAAAACAAUCUUAAGGCAGGGAaa-3'<br>3'-UAAUUUUUGUUAGAAUUCCGUCCCUUU-5'<br>5'-ATTAAAAACAATCTTAAGGCAGGGAAA-3' | (SEQ ID NO: 3079)<br>(SEQ ID NO: 5093)<br>(SEQ ID NO: 7107) |
| LDHA-2212 Target: | 5'-AAAAACAAUCUUAAGGCAGGGAAaa-3'<br>3'-AAUUUUGUUAGAAUUCCGUCCCUUUU-5'<br>5'-TTAAAAACAATCTTAAGGCAGGGAAAA-3' | (SEQ ID NO: 3080)<br>(SEQ ID NO: 5094)<br>(SEQ ID NO: 7108) |
| LDHA-2213 Target: | 5'-AAAACAAUCUUAAGGCAGGGAAAaa-3'<br>3'-AUUUUGUUAGAAUUCCGUCCCUUUUU-5'<br>5'-TAAAAACAATCTTAAGGCAGGGAAAAA-3' | (SEQ ID NO: 3081)<br>(SEQ ID NO: 5095)<br>(SEQ ID NO: 7109) |
| LDHA-2214 Target: | 5'-AAACAAUCUUAAGGCAGGGAAAAaa-3'<br>3'-UUUUGUUAGAAUUCCGUCCCUUUUUU-5'<br>5'-AAAAACAATCTTAAGGCAGGGAAAAAA-3' | (SEQ ID NO: 3082)<br>(SEQ ID NO: 5096)<br>(SEQ ID NO: 7110) |
| LDHA-2215 Target: | 5'-AACAAUCUUAAGGCAGGGAAAAAaa-3'<br>3'-UUUGUUAGAAUUCCGUCCCUUUUUUU-5'<br>5'-AAAACAATCTTAAGGCAGGGAAAAAAA-3' | (SEQ ID NO: 3083)<br>(SEQ ID NO: 5097)<br>(SEQ ID NO: 7111) |
| LDHA-2216 Target: | 5'-ACAAUCUUAAGGCAGGGAAAAAAaa-3'<br>3'-UUUGUUAGAAUUCCGUCCCUUUUUUUU-5'<br>5'-AAACAATCTTAAGGCAGGGAAAAAAAA-3' | (SEQ ID NO: 3084)<br>(SEQ ID NO: 5098)<br>(SEQ ID NO: 7112) |
| LDHA-2217 Target: | 5'-CAAUCUUAAGGCAGGGAAAAAAAaa-3'<br>3'-UUGUUAGAAUUCCGUCCCUUUUUUUUU-5'<br>5'-AACAATCTTAAGGCAGGGAAAAAAAAA-3' | (SEQ ID NO: 3085)<br>(SEQ ID NO: 5099)<br>(SEQ ID NO: 7113) |
| LDHA-2218 Target: | 5'-AAUCUUAAGGCAGGGAAAAAAAAaa-3'<br>3'-UGUUAGAAUUCCGUCCCUUUUUUUUUU-5'<br>5'-ACAATCTTAAGGCAGGGAAAAAAAAAA-3' | (SEQ ID NO: 3086)<br>(SEQ ID NO: 5100)<br>(SEQ ID NO: 7114) |
| LDHA-2219 Target: | 5'-AUCUUAAGGCAGGGAAAAAAAAAaa-3'<br>3'-GUUAGAAUUCCGUCCCUUUUUUUUUUU-5'<br>5'-CAATCTTAAGGCAGGGAAAAAAAAAAA-3' | (SEQ ID NO: 3087)<br>(SEQ ID NO: 5101)<br>(SEQ ID NO: 7115) |
| LDHA-2220 Target: | 5'-UCUUAAGGCAGGGAAAAAAAAAAaa-3'<br>3'-UUAGAAUUCCGUCCCUUUUUUUUUUUU-5'<br>5'-AATCTTAAGGCAGGGAAAAAAAAAAAA-3' | (SEQ ID NO: 3088)<br>(SEQ ID NO: 5102)<br>(SEQ ID NO: 7116) |
| LDHA-2221 Target: | 5'-CUUAAGGCAGGGAAAAAAAAAAAaa-3'<br>3'-UAGAAUUCCGUCCCUUUUUUUUUUUUU-5'<br>5'-ATCTTAAGGCAGGGAAAAAAAAAAAAA-3' | (SEQ ID NO: 3089)<br>(SEQ ID NO: 5103)<br>(SEQ ID NO: 7117) |
| LDHA-2222 Target: | 5'-UUAAGGCAGGGAAAAAAAAAAAAaa-3'<br>3'-AGAAUUCCGUCCCUUUUUUUUUUUUUU-5'<br>5'-TCTTAAGGCAGGGAAAAAAAAAAAAAA-3' | (SEQ ID NO: 3090)<br>(SEQ ID NO: 5104)<br>(SEQ ID NO: 7118) |
| LDHA-2223 Target: | 5'-UAAGGCAGGGAAAAAAAAAAAAAaa-3'<br>3'-GAAUUCCGUCCCUUUUUUUUUUUUUUU-5'<br>5'-CTTAAGGCAGGGAAAAAAAAAAAAAAA-3' | (SEQ ID NO: 3091)<br>(SEQ ID NO: 5105)<br>(SEQ ID NO: 7119) |
| LDHA-2224 Target: | 5'-AAGGCAGGGAAAAAAAAAAAAAAaa-3'<br>3'-AAUUCCGUCCCUUUUUUUUUUUUUUUU-5'<br>5'-TTAAGGCAGGGAAAAAAAAAAAAAAAA-3' | (SEQ ID NO: 3092)<br>(SEQ ID NO: 5106)<br>(SEQ ID NO: 7120) |
| LDHA-2225 Target: | 5'-AGGCAGGGAAAAAAAAAAAAAAAaa-3'<br>3'-AUUCCGUCCCUUUUUUUUUUUUUUUUU-5'<br>5'-TAAGGCAGGGAAAAAAAAAAAAAAAAA-3' | (SEQ ID NO: 3093)<br>(SEQ ID NO: 5107)<br>(SEQ ID NO: 7121) |
| LDHA-2226 Target: | 5'-GGCAGGGAAAAAAAAAAAAAAAAaa-3'<br>3'-UUCCGUCCCUUUUUUUUUUUUUUUUUU-5'<br>5'-AAGGCAGGGAAAAAAAAAAAAAAAAAA-3' | (SEQ ID NO: 3094)<br>(SEQ ID NO: 5108)<br>(SEQ ID NO: 7122) |

Within Tables 2, 3, 5, 7, 8, 10 and 12 above, underlined residues indicate 2'-O-methyl residues, UPPER CASE indicates ribonucleotides, and lower case denotes deoxyribonucleotides. The DsiRNA agents of Tables 2-3, 7-8 and 12 above are 25/27mer agents possessing a blunt end. The structures and/or modification patterning of the agents of Tables 2-3, 7-8 and 12 above can be readily adapted to the above generic sequence structures, e.g., the 3' overhang of the second strand can be extended or contracted, 2'-O-methylation of the second strand can be expanded towards the 5' end of the second strand, optionally at alternating sites, etc. Such further modifications are optional, as 25/27mer DsiRNAs with such modifications can also be readily designed from the above DsiRNA agents and are also expected to be functional inhibitors of lactate dehydrogenase expression. Similarly, the 27mer "blunt/blunt" DsiRNA structures and/or modification patterns of the agents of Tables 5 and 10 above can also be readily adapted to the above generic sequence structures, e.g., for application of modification patterning of the antisense strand to such structures and/or adaptation of such sequences to the above generic structures.

In certain embodiments, 27mer DsiRNAs possessing independent strand lengths each of 27 nucleotides are designed and synthesized for targeting of the same sites within the lactate dehydrogenase transcript as the asymmetric "25/27" structures shown in Tables 2-3, 7-8 and 12 herein. Exemplary "27/27" DsiRNAs are optionally designed with a "blunt/blunt" structure as shown for the DsiRNAs of Tables 5 and 10 above.

In certain embodiments, the dsRNA agents of the invention require, e.g., at least 19, at least 20, at least 21, at least 22, at least 23, at least 24, at least 25 or at least 26 residues of the first strand to be complementary to corresponding residues of the second strand. In certain related embodiments, these first strand residues complementary to corresponding residues of the second strand are optionally consecutive residues.

In certain DsiRNAmm ("DsiRNA mismatch") embodiments of the instant invention, mismatched base pairs are located within a "mismatch-tolerant region" which is defined herein with respect to the location of the projected Ago2 cut site of the corresponding target nucleic acid. The mismatch tolerant region is located "upstream of" the projected Ago2 cut site of the target strand. "Upstream" in this context will be understood as the 5'-most portion of the DsiRNAmm duplex, where 5' refers to the orientation of the sense strand of the DsiRNA duplex. Therefore, the mismatch tolerant region is upstream of the base on the sense (passenger) strand that corresponds to the projected Ago2 cut site of the target nucleic acid (see FIG. 1); alternatively, when referring to the antisense (guide) strand of the DsiRNAmm, the mismatch tolerant region can also be described as positioned downstream of the base that is complementary to the projected Ago2 cut site of the target nucleic acid, that is, the 3'-most portion of the antisense strand of the DsiRNAmm (where position 1 of the antisense strand is the 5' terminal nucleotide of the antisense strand, see FIG. 1).

In one embodiment, for example with numbering as depicted in FIG. 1, the mismatch tolerant region is positioned between and including base pairs 3-9 when numbered from the nucleotide starting at the 5' end of the sense strand of the duplex. Therefore, a DsiRNAmm of the invention possesses a single mismatched base pair at any one of positions 3, 4, 5, 6, 7, 8 or 9 of the sense strand of a right-hand extended DsiRNA (where position 1 is the 5' terminal nucleotide of the sense strand and position 9 is the nucleotide residue of the sense strand that is immediately 5' of the projected Ago2 cut site of the target lactate dehydrogenase RNA sequence corresponding to the sense strand sequence). In certain embodiments, for a DsiRNAmm that possesses a mismatched base pair nucleotide at any of positions 3, 4, 5, 6, 7, 8 or 9 of the sense strand, the corresponding mismatched base pair nucleotide of the antisense strand not only forms a mismatched base pair with the DsiRNAmm sense strand sequence, but also forms a mismatched base pair with a DsiRNAmm target lactate dehydrogenase RNA sequence (thus, complementarity between the antisense strand sequence and the sense strand sequence is disrupted at the mismatched base pair within the DsiRNAmm, and complementarity is similarly disrupted between the antisense strand sequence of the DsiRNAmm and the target lactate dehydrogenase RNA sequence). In alternative embodiments, the mismatch base pair nucleotide of the antisense strand of a DsiRNAmm only form a mismatched base pair with a corresponding nucleotide of the sense strand sequence of the DsiRNAmm, yet base pairs with its corresponding target lactate dehydrogenase RNA sequence nucleotide (thus, complementarity between the antisense strand sequence and the sense strand sequence is disrupted at the mismatched base pair within the DsiRNAmm, yet complementarity is maintained between the antisense strand sequence of the DsiRNAmm and the target lactate dehydrogenase RNA sequence).

A DsiRNAmm of the invention that possesses a single mismatched base pair within the mismatch-tolerant region (mismatch region) as described above (e.g., a DsiRNAmm harboring a mismatched nucleotide residue at any one of positions 3, 4, 5, 6, 7, 8 or 9 of the sense strand) can further include one, two or even three additional mismatched base pairs. In preferred embodiments, these one, two or three additional mismatched base pairs of the DsiRNAmm occur at position(s) 3, 4, 5, 6, 7, 8 and/or 9 of the sense strand (and at corresponding residues of the antisense strand). In one embodiment where one additional mismatched base pair is present within a DsiRNAmm, the two mismatched base pairs of the sense strand can occur, e.g., at nucleotides of both position 4 and position 6 of the sense strand (with mismatch also occurring at corresponding nucleotide residues of the antisense strand).

In DsiRNAmm agents possessing two mismatched base pairs, mismatches can occur consecutively (e.g., at consecutive positions along the sense strand nucleotide sequence). Alternatively, nucleotides of the sense strand that form mismatched base pairs with the antisense strand sequence can be interspersed by nucleotides that base pair with the antisense strand sequence (e.g., for a DsiRNAmm possessing mismatched nucleotides at positions 3 and 6, but not at positions 4 and 5, the mismatched residues of sense strand positions 3 and 6 are interspersed by two nucleotides that form matched base pairs with corresponding residues of the antisense strand). For example, two residues of the sense strand (located within the mismatch-tolerant region of the sense strand) that form mismatched base pairs with the corresponding antisense strand sequence can occur with zero, one, two, three, four or five matched base pairs located between these mismatched base pairs.

For certain DsiRNAmm agents possessing three mismatched base pairs, mismatches can occur consecutively (e.g., in a triplet along the sense strand nucleotide sequence). Alternatively, nucleotides of the sense strand that form mismatched base pairs with the antisense strand sequence can be interspersed by nucleotides that form matched base pairs with the antisense strand sequence (e.g., for a DsiR- NAmm possessing mismatched nucleotides at positions 3, 4 and 8, but not at positions 5, 6 and 7, the mismatched residues of sense strand positions 3 and 4 are adjacent to one another, while the mismatched residues of sense strand positions 4 and 8 are interspersed by three nucleotides that form matched base pairs with corresponding residues of the antisense strand). For example, three residues of the sense strand (located within the mismatch-tolerant region of the sense strand) that form mismatched base pairs with the corresponding antisense strand sequence can occur with zero, one, two, three or four matched base pairs located between any two of these mismatched base pairs.

For certain DsiRNAmm agents possessing four mismatched base pairs, mismatches can occur consecutively (e.g., in a quadruplet along the sense strand nucleotide sequence). Alternatively, nucleotides of the sense strand that form mismatched base pairs with the antisense strand sequence can be interspersed by nucleotides that form matched base pairs with the antisense strand sequence (e.g., for a DsiRNAmm possessing mismatched nucleotides at positions 3, 5, 7 and 8, but not at positions 4 and 6, the mismatched residues of sense strand positions 7 and 8 are adjacent to one another, while the mismatched residues of sense strand positions 3 and 5 are interspersed by one nucleotide that forms a matched base pair with the corresponding residue of the antisense strand—similarly, the mismatched residues of sense strand positions 5 and 7 are also interspersed by one nucleotide that forms a matched base pair with the corresponding residue of the antisense strand). For example, four residues of the sense strand (located within the mismatch-tolerant region of the sense strand) that form mismatched base pairs with the corresponding antisense strand sequence can occur with zero, one, two or three matched base pairs located between any two of these mismatched base pairs.

In another embodiment, for example with numbering also as depicted in FIG. 1, a DsiRNAmm of the invention comprises a mismatch tolerant region which possesses a single mismatched base pair nucleotide at any one of positions 17, 18, 19, 20, 21, 22 or 23 of the antisense strand of the DsiRNA (where position 1 is the 5' terminal nucleotide of the antisense strand and position 17 is the nucleotide residue of the antisense strand that is immediately 3' (downstream) in the antisense strand of the projected Ago2 cut site of the target lactate dehydrogenase RNA sequence sufficiently complementary to the antisense strand sequence). In certain embodiments, for a DsiRNAmm that possesses a mismatched base pair nucleotide at any of positions 17, 18, 19, 20, 21, 22 or 23 of the antisense strand with respect to the sense strand of the DsiRNAmm, the mismatched base pair nucleotide of the antisense strand not only forms a mismatched base pair with the DsiRNAmm sense strand sequence, but also forms a mismatched base pair with a DsiRNAmm target lactate dehydrogenase RNA sequence (thus, complementarity between the antisense strand sequence and the sense strand sequence is disrupted at the mismatched base pair within the DsiRNAmm, and complementarity is similarly disrupted between the antisense strand sequence of the DsiRNAmm and the target lactate dehydrogenase RNA sequence). In alternative embodiments, the mismatch base pair nucleotide of the antisense strand of a DsiRNAmm only forms a mismatched base pair with a corresponding nucleotide of the sense strand sequence of the DsiRNAmm, yet base pairs with its corresponding target lactate dehydrogenase RNA sequence nucleotide (thus, complementarity between the antisense strand sequence and the sense strand sequence is disrupted at the mismatched base pair within the DsiRNAmm, yet complementarity is maintained between the antisense strand sequence of the DsiRNAmm and the target lactate dehydrogenase RNA sequence).

A DsiRNAmm of the invention that possesses a single mismatched base pair within the mismatch-tolerant region as described above (e.g., a DsiRNAmm harboring a mismatched nucleotide residue at positions 17, 18, 19, 20, 21, 22 or 23 of the antisense strand) can further include one, two or even three additional mismatched base pairs. In preferred embodiments, these one, two or three additional mismatched base pairs of the DsiRNAmm occur at position(s) 17, 18, 19, 20, 21, 22 and/or 23 of the antisense strand (and at corresponding residues of the sense strand). In one embodiment where one additional mismatched base pair is present within a DsiRNAmm, the two mismatched base pairs of the antisense strand can occur, e.g., at nucleotides of both position 18 and position 20 of the antisense strand (with mismatch also occurring at corresponding nucleotide residues of the sense strand).

In DsiRNAmm agents possessing two mismatched base pairs, mismatches can occur consecutively (e.g., at consecutive positions along the antisense strand nucleotide sequence). Alternatively, nucleotides of the antisense strand that form mismatched base pairs with the sense strand sequence can be interspersed by nucleotides that base pair with the sense strand sequence (e.g., for a DsiRNAmm possessing mismatched nucleotides at positions 17 and 20, but not at positions 18 and 19, the mismatched residues of antisense strand positions 17 and 20 are interspersed by two nucleotides that form matched base pairs with corresponding residues of the sense strand). For example, two residues of the antisense strand (located within the mismatch-tolerant region of the sense strand) that form mismatched base pairs with the corresponding sense strand sequence can occur with zero, one, two, three, four, five, six or seven matched base pairs located between these mismatched base pairs.

For certain DsiRNAmm agents possessing three mismatched base pairs, mismatches can occur consecutively (e.g., in a triplet along the antisense strand nucleotide sequence). Alternatively, nucleotides of the antisense strand that form mismatched base pairs with the sense strand sequence can be interspersed by nucleotides that form matched base pairs with the sense strand sequence (e.g., for a DsiRNAmm possessing mismatched nucleotides at positions 17, 18 and 22, but not at positions 19, 20 and 21, the mismatched residues of antisense strand positions 17 and 18 are adjacent to one another, while the mismatched residues of antisense strand positions 18 and 122 are interspersed by three nucleotides that form matched base pairs with corresponding residues of the sense strand). For example, three residues of the antisense strand (located within the mismatch-tolerant region of the antisense strand) that form mismatched base pairs with the corresponding sense strand sequence can occur with zero, one, two, three, four, five or six matched base pairs located between any two of these mismatched base pairs.

For certain DsiRNAmm agents possessing four mismatched base pairs, mismatches can occur consecutively (e.g., in a quadruplet along the antisense strand nucleotide sequence). Alternatively, nucleotides of the antisense strand that form mismatched base pairs with the sense strand sequence can be interspersed by nucleotides that form matched base pairs with the sense strand sequence (e.g., for a DsiRNAmm possessing mismatched nucleotides at positions 18, 20, 22 and 23, but not at positions 19 and 21, the mismatched residues of antisense strand positions 22 and 23 are adjacent to one another, while the mismatched residues of antisense strand positions 18 and 20 are interspersed by one nucleotide that forms a matched base pair with the corresponding residue of the sense strand—similarly, the mismatched residues of antisense strand positions 20 and 22 are also interspersed by one nucleotide that forms a matched base pair with the corresponding residue of the sense strand). For example, four residues of the antisense strand (located within the mismatch-tolerant region of the antisense strand) that form mismatched base pairs with the corresponding sense strand sequence can occur with zero, one, two, three, four or five matched base pairs located between any two of these mismatched base pairs.

For reasons of clarity, the location(s) of mismatched nucleotide residues within the above DsiRNAmm agents are numbered in reference to the 5' terminal residue of either sense or antisense strands of the DsiRNAmm. The numbering of positions located within the mismatch-tolerant region (mismatch region) of the antisense strand can shift with variations in the proximity of the 5' terminus of the sense or antisense strand to the projected Ago2 cleavage site. Thus, the location(s) of preferred mismatch sites within either antisense strand or sense strand can also be identified as the permissible proximity of such mismatches to the projected Ago2 cut site. Accordingly, in one preferred embodiment, the position of a mismatch nucleotide of the sense strand of a DsiRNAmm is the nucleotide residue of the sense strand that is located immediately 5' (upstream) of the projected Ago2 cleavage site of the corresponding target lactate dehydrogenase RNA sequence. In other preferred embodiments, a mismatch nucleotide of the sense strand of a DsiRNAmm is positioned at the nucleotide residue of the sense strand that is located two nucleotides 5' (upstream) of the projected Ago2 cleavage site, three nucleotides 5' (upstream) of the projected Ago2 cleavage site, four nucleotides 5' (upstream) of the projected Ago2 cleavage site, five nucleotides 5' (upstream) of the projected Ago2 cleavage site, six nucleotides 5' (upstream) of the projected Ago2 cleavage site, seven nucleotides 5' (upstream) of the projected Ago2 cleavage site, eight nucleotides 5' (upstream) of the projected Ago2 cleavage site, or nine nucleotides 5' (upstream) of the projected Ago2 cleavage site.

Exemplary single mismatch-containing 25/27mer DsiRNAs (DsiRNAmm) include the following structures (such mismatch-containing structures may also be incorporated into other exemplary DsiRNA structures shown herein).

```
5'-XX MXXXXXXXXXXXXXXXXXXXXXDD-3'
3'-XXXX MXXXXXXXXXXXXXXXXXXXXXXX-5'
5'-XXX MXXXXXXXXXXXXXXXXXXXXXDD-3'
3'-XXXXX MXXXXXXXXXXXXXXXXXXXXXXX-5'
```

-continued
```
5'-XXXX MXXXXXXXXXXXXXXXXXXXXDD-3'
3'-XXXXXX MXXXXXXXXXXXXXXXXXXXXX-5'
5'-XXXXX MXXXXXXXXXXXXXXXXXXXDD-3'
3'-XXXXXXX MXXXXXXXXXXXXXXXXXXXX-5'
5'-XXXXXX MXXXXXXXXXXXXXXXXXXDD-3'
3'-XXXXXXXX MXXXXXXXXXXXXXXXXXXX-5'
5'-XXXXXXX MXXXXXXXXXXXXXXXXXDD-3'
3'-XXXXXXXXX MXXXXXXXXXXXXXXXXXX-5'
5'-XXXXXXXX MXXXXXXXXXXXXXXXXDD-3'
3'-XXXXXXXXXX MXXXXXXXXXXXXXXXXX-5'
``` wherein "X"=RNA, "D"=DNA and "M"=Nucleic acid residues (RNA, DNA or non-natural or modified nucleic acids) that do not base pair (hydrogen bond) with corresponding "M" residues of otherwise complementary strand when strands are annealed. Any of the residues of such agents can optionally be 2'-O-methyl RNA monomers—alternating positioning of 2'-O-methyl RNA monomers that commences from the 3'-terminal residue of the bottom (second) strand, as shown above, can also be used in the above DsiRNAmm agents. For the above mismatch structures, the top strand is the sense strand, and the bottom strand is the antisense strand.

In certain embodiments, a DsiRNA of the invention can contain mismatches that exist in reference to the target lactate dehydrogenase RNA sequence yet do not necessarily exist as mismatched base pairs within the two strands of the DsiRNA—thus, a DsiRNA can possess perfect complementarity between first and second strands of a DsiRNA, yet still possess mismatched residues in reference to a target lactate dehydrogenase RNA (which, in certain embodiments, may be advantageous in promoting efficacy and/or potency and/or duration of effect). In certain embodiments, where mismatches occur between antisense strand and target lactate dehydrogenase RNA sequence, the position of a mismatch is located within the antisense strand at a position(s) that corresponds to a sequence of the sense strand located 5' of the projected Ago2 cut site of the target region—e.g., antisense strand residue(s) positioned within the antisense strand to the 3' of the antisense residue which is complementary to the projected Ago2 cut site of the target sequence.

Exemplary 25/27mer DsiRNAs that harbor a single mismatched residue in reference to target sequences include the following structures.

```
Target RNA Sequence:      5'-...AXXXXXXXXXXXXXXXXXXX...-3'
DsiRNAmm Sense Strand:    5'-XXXXXXXXXXXXXXXXXXXXXXXDD-3'
DsiRNAmm Antisense Strand: 3'-EXXXXXXXXXXXXXXXXXXXXXXXXX-5'

Target RNA Sequence:      5'-...XAXXXXXXXXXXXXXXXXXX...-3'
DsiRNAmm Sense Strand:    5'-XXXXXXXXXXXXXXXXXXXXXXXDD-3'
DsiRNAmm Antisense Strand: 3'-XEXXXXXXXXXXXXXXXXXXXXXXXX-5'

Target RNA Sequence:      5'-...AXXXXXXXXXXXXXXXXXX...-3'
DsiRNAmm Sense Strand:    5'-BXXXXXXXXXXXXXXXXXXXXXXDD-3'
DsiRNAmm Antisense Strand: 3'-XXEXXXXXXXXXXXXXXXXXXXXXXX-5'

Target RNA Sequence:      5'-...XAXXXXXXXXXXXXXXXXX...-3'
```

```
                         -continued
DsiRNAmm Sense Strand:     5'-XBXXXXXXXXXXXXXXXXXXXXXDD-3'
DsiRNAmm Antisense Strand: 3'-XXXEXXXXXXXXXXXXXXXXXXXXXXX-5'

Target RNA Sequence:       5'-...XXAXXXXXXXXXXXXXXXX...-3'
DsiRNAmm Sense Strand:     5'-XXBXXXXXXXXXXXXXXXXXXXXDD-3'
DsiRNAmm Antisense Strand: 3'-XXXXEXXXXXXXXXXXXXXXXXXXXXX-5'

Target RNA Sequence:       5'-...XXXAXXXXXXXXXXXXXXX...-3'
DsiRNAmm Sense Strand:     5'-XXXBXXXXXXXXXXXXXXXXXXXDD-3'
DsiRNAmm Antisense Strand: 3'-XXXXXEXXXXXXXXXXXXXXXXXXXXX-5'

Target RNA Sequence:       5'-...XXXXAXXXXXXXXXXXXXX...-3'
DsiRNAmm Sense Strand:     5'-XXXXBXXXXXXXXXXXXXXXXXXDD-3'
DsiRNAmm Antisense Strand: 3'-XXXXXXEXXXXXXXXXXXXXXXXXXXX-5'

Target RNA Sequence:       5'-...XXXXXAXXXXXXXXXXXXX...-3'
DsiRNAmm Sense Strand:     5'-XXXXXBXXXXXXXXXXXXXXXXXDD-3'
DsiRNAmm Antisense Strand: 3'-XXXXXXXEXXXXXXXXXXXXXXXXXXX-5'

Target RNA Sequence:       5'-...XXXXXXAXXXXXXXXXXXX...-3'
DsiRNAmm Sense Strand:     5'-XXXXXXBXXXXXXXXXXXXXXXXDD-3'
DsiRNAmm Antisense Strand: 3'-XXXXXXXXEXXXXXXXXXXXXXXXXXX-5'

Target RNA Sequence:       5'-...XXXXXXXAXXXXXXXXXXX...-3'
DsiRNAmm Sense Strand:     5'-XXXXXXXBXXXXXXXXXXXXXXXDD-3'
DsiRNAmm Antisense Strand: 3'-XXXXXXXXXEXXXXXXXXXXXXXXXXX-5'

Target RNA Sequence:       5'-...XXXXXXXXAXXXXXXXXXX...-3'
DsiRNAmm Sense Strand:     5'-XXXXXXXXBXXXXXXXXXXXXXXDD-3'
DsiRNAmm Antisense Strand: 3'-XXXXXXXXXXEXXXXXXXXXXXXXXXX-5'
``` wherein "X"=RNA, "D"=DNA and "E"=Nucleic acid residues (RNA, DNA or non-natural or modified nucleic acids) that do not base pair (hydrogen bond) with corresponding "A" RNA residues of otherwise complementary (target) strand when strands are annealed, yet optionally do base pair with corresponding "B" residues ("B" residues are also RNA, DNA or non-natural or modified nucleic acids). Any of the residues of such agents can optionally be 2'-O-methyl RNA monomers—alternating positioning of 2'-O-methyl RNA monomers that commences from the 3'-terminal residue of the bottom (second) strand, as shown above, can also be used in the above DsiRNA agents.

In certain embodiments, the guide strand of a dsRNA of the invention that is sufficiently complementary to a target RNA (e.g., mRNA) along at least 19 nucleotides of the target gene sequence to reduce target gene expression is not perfectly complementary to the at least 19 nucleotide long target gene sequence. Rather, it is appreciated that the guide strand of a dsRNA of the invention that is sufficiently complementary to a target mRNA along at least 19 nucleotides of a target RNA sequence to reduce target gene expression can have one, two, three, or even four or more nucleotides that are mismatched with the 19 nucleotide or longer target strand sequence. Thus, for a 19 nucleotide target RNA sequence, the guide strand of a dsRNA of the invention can be sufficiently complementary to the target RNA sequence to reduce target gene levels while possessing, e.g., only 15/19, 16/19, 17/19 or 18/19 matched nucleotide residues between guide strand and target RNA sequence.

In addition to the above-exemplified structures, dsRNAs of the invention can also possess one, two or three additional residues that form further mismatches with the target lactate dehydrogenase RNA sequence. Such mismatches can be consecutive, or can be interspersed by nucleotides that form matched base pairs with the target lactate dehydrogenase RNA sequence. Where interspersed by nucleotides that form matched base pairs, mismatched residues can be spaced apart from each other within a single strand at an interval of one, two, three, four, five, six, seven or even eight base paired nucleotides between such mismatch-forming residues.

As for the above-described DsiRNAmm agents, a preferred location within dsRNAs (e.g., DsiRNAs) for antisense strand nucleotides that form mismatched base pairs with target lactate dehydrogenase RNA sequence (yet may or may not form mismatches with corresponding sense strand nucleotides) is within the antisense strand region that is located 3' (downstream) of the antisense strand sequence which is complementary to the projected Ago2 cut site of the DsiRNA (e.g., in FIG. 1, the region of the antisense strand which is 3' of the projected Ago2 cut site is preferred for mismatch-forming residues and happens to be located at positions 17-23 of the antisense strand for the 25/27mer agent shown in FIG. 1). Thus, in one embodiment, the position of a mismatch nucleotide (in relation to the target lactate dehydrogenase RNA sequence) of the antisense strand of a DsiRNAmm is the nucleotide residue of the antisense strand that is located immediately 3' (downstream) within the antisense strand sequence of the projected Ago2 cleavage site of the corresponding target lactate dehydrogenase RNA sequence. In other preferred embodiments, a mismatch nucleotide of the antisense strand of a DsiRNAmm (in relation to the target lactate dehydrogenase RNA sequence) is positioned at the nucleotide residue of the antisense strand that is located two nucleotides 3' (downstream) of the corresponding projected Ago2 cleavage site, three nucleotides 3' (downstream) of the corresponding projected Ago2 cleavage site, four nucleotides 3' (downstream) of the corresponding projected Ago2 cleavage site, five nucleotides 3' (downstream) of the corresponding projected Ago2 cleavage site, six nucleotides 3' (downstream) of the projected Ago2 cleavage site, seven nucleotides 3' (downstream) of the projected Ago2 cleavage site, eight nucleotides 3' (downstream) of the projected Ago2 cleavage site, or nine nucleotides 3' (downstream) of the projected Ago2 cleavage site.

In dsRNA agents possessing two mismatch-forming nucleotides of the antisense strand (where mismatch-forming nucleotides are mismatch forming in relation to target lactate dehydrogenase RNA sequence), mismatches can occur consecutively (e.g., at consecutive positions along the antisense strand nucleotide sequence). Alternatively, nucleotides of the antisense strand that form mismatched base pairs with the target lactate dehydrogenase RNA sequence can be interspersed by nucleotides that base pair with the target lactate dehydrogenase RNA sequence (e.g., for a DsiRNA possessing mismatch-forming nucleotides at positions 17 and 20 (starting from the 5' terminus (position 1) of the antisense strand of the 25/27mer agent shown in FIG. 1), but not at positions 18 and 19, the mismatched residues of sense strand positions 17 and 20 are interspersed by two nucleotides that form matched base pairs with corresponding residues of the target lactate dehydrogenase RNA sequence). For example, two residues of the antisense strand (located within the mismatch-tolerant region of the antisense strand) that form mismatched base pairs with the corresponding target lactate dehydrogenase RNA sequence can occur with zero, one, two, three, four or five matched base pairs (with respect to target lactate dehydrogenase RNA sequence) located between these mismatch-forming base pairs.

For certain dsRNAs possessing three mismatch-forming base pairs (mismatch-forming with respect to target lactate dehydrogenase RNA sequence), mismatch-forming nucleotides can occur consecutively (e.g., in a triplet along the antisense strand nucleotide sequence). Alternatively, nucleotides of the antisense strand that form mismatched base pairs with the target lactate dehydrogenase RNA sequence can be interspersed by nucleotides that form matched base pairs with the target lactate dehydrogenase RNA sequence (e.g., for a DsiRNA possessing mismatched nucleotides at positions 17, 18 and 22, but not at positions 19, 20 and 21, the mismatch-forming residues of antisense strand positions 17 and 18 are adjacent to one another, while the mismatch-forming residues of antisense strand positions 18 and 22 are interspersed by three nucleotides that form matched base pairs with corresponding residues of the target lactate dehydrogenase RNA). For example, three residues of the antisense strand (located within the mismatch-tolerant region of the antisense strand) that form mismatched base pairs with the corresponding target lactate dehydrogenase RNA sequence can occur with zero, one, two, three or four matched base pairs located between any two of these mismatch-forming base pairs.

For certain dsRNAs possessing four mismatch-forming base pairs (mismatch-forming with respect to target lactate dehydrogenase RNA sequence), mismatch-forming nucleotides can occur consecutively (e.g., in a quadruplet along the sense strand nucleotide sequence). Alternatively, nucleotides of the antisense strand that form mismatched base pairs with the target lactate dehydrogenase RNA sequence can be interspersed by nucleotides that form matched base pairs with the target lactate dehydrogenase RNA sequence (e.g., for a DsiRNA possessing mismatch-forming nucleotides at positions 17, 19, 21 and 22, but not at positions 18 and 20, the mismatch-forming residues of antisense strand positions 21 and 22 are adjacent to one another, while the mismatch-forming residues of antisense strand positions 17 and 19 are interspersed by one nucleotide that forms a matched base pair with the corresponding residue of the target lactate dehydrogenase RNA sequence—similarly, the mismatch-forming residues of antisense strand positions 19 and 21 are also interspersed by one nucleotide that forms a matched base pair with the corresponding residue of the target lactate dehydrogenase RNA sequence). For example, four residues of the antisense strand (located within the mismatch-tolerant region of the antisense strand) that form mismatched base pairs with the corresponding target lactate dehydrogenase RNA sequence can occur with zero, one, two or three matched base pairs located between any two of these mismatch-forming base pairs.

The above DsiRNAmm and other dsRNA structures are described in order to exemplify certain structures of DsiRNAmm and dsRNA agents. Design of the above DsiRNAmm and dsRNA structures can be adapted to generate, e.g., DsiRNAmm forms of other DsiRNA structures shown infra. As exemplified above, dsRNAs can also be designed that possess single mismatches (or two, three or four mismatches) between the antisense strand of the dsRNA and a target sequence, yet optionally can retain perfect complementarity between sense and antisense strand sequences of a dsRNA.

It is further noted that the dsRNA agents exemplified infra can also possess insertion/deletion (in/del) structures within their double-stranded and/or target lactate dehydrogenase RNA-aligned structures. Accordingly, the dsRNAs of the invention can be designed to possess in/del variations in, e.g., antisense strand sequence as compared to target lactate dehydrogenase RNA sequence and/or antisense strand sequence as compared to sense strand sequence, with preferred location(s) for placement of such in/del nucleotides corresponding to those locations described above for positioning of mismatched and/or mismatch-forming base pairs.

It is also noted that the DsiRNAs of the instant invention can tolerate mismatches within the 3'-terminal region of the sense strand/5'-terminal region of the antisense strand, as this region is modeled to be processed by Dicer and liberated from the guide strand sequence that loads into RISC. Exemplary DsiRNA structures of the invention that harbor such mismatches include the following:

```
Target RNA Sequence:    5'-...XXXXXXXXXXXXXXXXXXXXXHXXX...-3'
DsiRNA Sense Strand:    5'-XXXXXXXXXXXXXXXXXXXXXIXDD-3'
DsiRNA Antisense Strand: 3'-XXXXXXXXXXXXXXXXXXXXXXJXXX-5'

Target RNA Sequence:    5'-...XXXXXXXXXXXXXXXXXXXXXHXX...-3'
DsiRNA Sense Strand:    5'-XXXXXXXXXXXXXXXXXXXXXIDD-3'
DsiRNA Antisense Strand: 3'-XXXXXXXXXXXXXXXXXXXXXXJXX-5'

Target RNA Sequence:    5'-...XXXXXXXXXXXXXXXXXXXXXHX...-3'
DsiRNA Sense Strand:    5'-XXXXXXXXXXXXXXXXXXXXXID-3'
DsiRNA Antisense Strand: 3'-XXXXXXXXXXXXXXXXXXXXXXJX-5'

Target RNA Sequence:    5'-...XXXXXXXXXXXXXXXXXXXXXH...-3'
DsiRNA Sense Strand:    5'-XXXXXXXXXXXXXXXXXXXXXDI-3'
DsiRNA Antisense Strand: 3'-XXXXXXXXXXXXXXXXXXXXXXJ-5'
``` wherein "X"=RNA, "D"=DNA and "I" and "J"=Nucleic acid residues (RNA, DNA or non-natural or modified nucleic acids) that do not base pair (hydrogen bond) with one another, yet optionally "J" is complementary to target RNA sequence nucleotide "H". Any of the residues of such agents can optionally be 2'-O-methyl RNA monomers—alternating positioning of 2'-O-methyl RNA monomers that commences from the 3'-terminal residue of the bottom (second) strand, as shown above—or any of the above-described methylation patterns—can also be used in the above DsiRNA agents. The above mismatches can also be combined within the DsiRNAs of the instant invention.

In the below exemplary structures, such mismatches are introduced within the asymmetric LDHA-1287 DsiRNA (newly-introduced mismatch residues are italicized):

LDHA-1287 25/27mer DsiRNA, mismatch position=19 of sense strand (from 5'-terminus)

```
5'-CAAUUUUAAAGUCUUCUG^UUGUCat-3'   (SEQ ID NO: 7127)
3'-ACGUUAAAAUUUCAGAAGAC_UACAGUA-5' (SEQ ID NO: 108)
```

Optionally, the mismatched 'U' residue of position 19 of the sense strand is alternatively 'C' or 'G'.

LDHA-1287 25/27mer DsiRNA, mismatch position=20 of sense strand (from 5'-terminus)

```
5'-CAAUUUUAAAGUCUUCUGA^AGUCat-3'   (SEQ ID NO: 7128)
3'-ACGUUAAAAUUUCAGAAGACU_ACAGUA-5' (SEQ ID NO: 108)
```

Optionally, the mismatched 'A' residue of position 20 of the sense strand is alternatively 'C' or 'G'.

LDHA-1287 25/27mer DsiRNA, mismatch position=21 of sense strand (from 5'-terminus)

```
5'-CAAUUUUAAAGUCUUCUGAU^AUCat-3'   (SEQ ID NO: 7129)
3'-ACGUUAAAAUUUCAGAAGACUA_CAGUA-5' (SEQ ID NO: 108)
```

Optionally, the mismatched 'A' residue of position 21 of the sense strand is alternatively 'U' or 'C'.

LDHA-1287 25/27mer DsiRNA, mismatch position=22 of sense strand (from 5'-terminus)

```
5'-CAAUUUUAAAGUCUUCUGAUG^GCat-3'   (SEQ ID NO: 7130)
3'-ACGUUAAAAUUUCAGAAGACUAC_AGUA-5' (SEQ ID NO: 108)
```

Optionally, the mismatched 'G' residue of position 22 of the sense strand is alternatively 'A' or 'C'.

LDHA-1287 25/27mer DsiRNA, mismatch position=23 of sense strand (from 5'-terminus)

```
5'-CAAUUUUAAAGUCUUCUGAUGU^Aat-3'   (SEQ ID NO: 7131)
3'-ACGUUAAAAUUUCAGAAGACUACA_GUA-5' (SEQ ID NO: 108)
```

Optionally, the mismatched 'A' residue of position 23 of the sense strand is alternatively 'U' or 'G'.

LDHA-1287 25/27mer DsiRNA, mismatch position=24 of sense strand (from 5'-terminus)

```
5'-CAAUUUUAAAGUCUUCUGAUGUC^t-3'   (SEQ ID NO: 7132)
3'-ACGUUAAAAUUUCAGAAGACUACAG_UA-5' (SEQ ID NO: 108)
```

Optionally, the mismatched 'g' residue of position 24 of the sense strand is alternatively 't' or 'c'.

LDHA-1287 25/27mer DsiRNA, mismatch position=25 of sense strand (from 5'-terminus)

```
5'-CAAUUUUAAAGUCUUCUGAUGUCa-3'    (SEQ ID NO: 7133)
3'-ACGUUAAAAUUUCAGAAGACUACAGU_A-5' (SEQ ID NO: 108)
```

Optionally, the mismatched 'a' residue of position 25 of the sense strand is alternatively 'c' or 'g'.

LDHA-1287 25/27mer DsiRNA, mismatch position=1 of antisense strand (from 5'-terminus)

```
5'-CAAUUUUAAAGUCUUCUGAUGUCa^t-3'  (SEQ ID NO: 252)
3'-ACGUUAAAAUUUCAGAAGACUACAGU_U-5' (SEQ ID NO: 7134)
```

Optionally, the mismatched 'U' residue of position 1 of the antisense strand is alternatively 'G' or 'C'.

LDHA-1287 25/27mer DsiRNA, mismatch position=2 of antisense strand (from 5'-terminus)

```
5'-CAAUUUUAAAGUCUUCUGAUGUC^at-3'  (SEQ ID NO: 252)
3'-ACGUUAAAAUUUCAGAAGACUACAG_CA-5' (SEQ ID NO: 7135)
```

Optionally, the mismatched 'C' residue of position 2 of the antisense strand is alternatively 'A' or 'G'.

LDHA-1287 25/27mer DsiRNA, mismatch position=3 of antisense strand (from 5'-terminus)

```
5'-CAAUUUUAAAGUCUUCUGAUGU^Cat-3'  (SEQ ID NO: 252)
3'-ACGUUAAAAUUUCAGAAGACUACA_UUA-5' (SEQ ID NO: 7136)
```

Optionally, the mismatched 'U' residue of position 3 of the antisense strand is alternatively 'A' or 'C'.

LDHA-1287 25/27mer DsiRNA, mismatch position=4 of antisense strand (from 5'-terminus)

```
5'-CAAUUUUAAAGUCUUCUGAUG^UCat-3'  (SEQ ID NO: 252)
3'-ACGUUAAAAUUUCAGAAGACUAC_CGUA-5' (SEQ ID NO: 7137)
```

Optionally, the mismatched 'C' residue of position 4 of the antisense strand is alternatively 'U' or 'G'.

LDHA-1287 25/27mer DsiRNA, mismatch position=5 of antisense strand (from 5'-terminus)

```
5'-CAAUUUUAAAGUCUUCUGAU^GUCat-3'  (SEQ ID NO: 252)
3'-ACGUUAAAAUUUCAGAAGACUA_GAGUA-5' (SEQ ID NO: 7138)
```

Optionally, the mismatched 'U' residue of position 5 of the antisense strand is alternatively 'A' or 'G'.

LDHA-1287 25/27mer DsiRNA, mismatch position=6 of antisense strand (from 5'-terminus)

```
5'-CAAUUUUAAAGUCUUCUGAUGUCat-3'  (SEQ ID NO: 252)
3'-ACGUUAAAAUUUCAGAAGACUUCAGUA-5' (SEQ ID NO: 7139)
```

Optionally, the mismatched 'U' residue of position 6 of the antisense strand is alternatively 'C' or 'G'.
LDHA-1287 25/27mer DsiRNA, mismatch position=7 of antisense strand (from 5'-terminus)

```
5'-CAAUUUUAAAGUCUUCUGAUGCat-3'  (SEQ ID NO: 252)
3'-ACGUUAAAAUUUCAGAAGACAACAGUA-5' (SEQ ID NO: 7140)
```

Optionally, the mismatched 'A' residue of position 7 of the antisense strand is alternatively 'C' or 'G'.

For the above oligonucleotide strand sequences, it is contemplated that the sense strand sequence of one depicted duplex can be combined with an antisense strand of another depicted duplex, thereby forming a distinct duplex—in certain instances, such duplexes contain a mismatched residue with respect to the lactate dehydrogenase target transcript sequence, while such sense and antisense strand sequences do not present a mismatch at this residue with respect to one another (e.g., duplexes comprising SEQ ID NOs: 7127 and 7140; SEQ ID NOs: 7128 and 7139; SEQ ID NOs: 7129 and 7138, etc., are contemplated as exemplary of such duplexes).

In further exemplary structures, mismatches are introduced within the asymmetric LDHA-370 DsiRNA (newly-introduced mismatch residues are italicized):
LDHA-370 25/27mer DsiRNA, mismatch position=19 of sense strand (from 5'-terminus)

```
5'-UUGUUGGGGUUGGUGCUGAUGGCat-3'  (SEQ ID NO: 7145)
3'-UCAACAACCCCAACCACGACAACCGUA-5' (SEQ ID NO: 84)
```

Optionally, the mismatched 'A' residue of position 19 of the sense strand is alternatively 'C' or 'G'.
LDHA-370 25/27mer DsiRNA, mismatch position=20 of sense strand (from 5'-terminus)

```
5'-UUGUUGGGGUUGGUGCUGUAGGCat-3'  (SEQ ID NO: 7146)
3'-UCAACAACCCCAACCACGACAACCGUA-5' (SEQ ID NO: 84)
```

Optionally, the mismatched 'A' residue of position 20 of the sense strand is alternatively 'C' or 'G'.
LDHA-370 25/27mer DsiRNA, mismatch position=21 of sense strand (from 5'-terminus)

```
5'-UUGUUGGGGUUGGUGCUGUUAGCat-3'  (SEQ ID NO: 7147)
3'-UCAACAACCCCAACCACGACAACCGUA-5' (SEQ ID NO: 84)
```

Optionally, the mismatched 'A' residue of position 21 of the sense strand is alternatively 'U' or 'C'.
LDHA-370 25/27mer DsiRNA, mismatch position=22 of sense strand (from 5'-terminus)

```
5'-UUGUUGGGGUUGGUGCUGUUGUCat-3'  (SEQ ID NO: 7148)
3'-UCAACAACCCCAACCACGACAACCGUA-5' (SEQ ID NO: 84)
```

Optionally, the mismatched 'U' residue of position 22 of the sense strand is alternatively 'A' or 'C'.
LDHA-370 25/27mer DsiRNA, mismatch position=23 of sense strand (from 5'-terminus)

```
5'-UUGUUGGGGUUGGUGCUGUUGGAat-3'  (SEQ ID NO: 7149)
3'-UCAACAACCCCAACCACGACAACCGUA-5' (SEQ ID NO: 84)
```

Optionally, the mismatched 'A' residue of position 23 of the sense strand is alternatively 'U' or 'G'.
LDHA-370 25/27mer DsiRNA, mismatch position=24 of sense strand (from 5'-terminus)

```
5'-UUGUUGGGGUUGGUGCUGUUGGCgt-3'  (SEQ ID NO: 7150)
3'-UCAACAACCCCAACCACGACAACCGUA-5' (SEQ ID NO: 84)
```

Optionally, the mismatched 'g' residue of position 24 of the sense strand is alternatively 't' or 'c'.
LDHA-370 25/27mer DsiRNA, mismatch position=25 of sense strand (from 5'-terminus)

```
5'-UUGUUGGGGUUGGUGCUGUUGGCaa-3'  (SEQ ID NO: 7151)
3'-UCAACAACCCCAACCACGACAACCGUA-5' (SEQ ID NO: 84)
```

Optionally, the mismatched 'a' residue of position 25 of the sense strand is alternatively 'c' or 'g'.
LDHA-370 25/27mer DsiRNA, mismatch position=1 of antisense strand (from 5'-terminus)

```
5'-UUGUUGGGGUUGGUGCUGUUGGCat-3'  (SEQ ID NO: 12)
3'-UCAACAACCCCAACCACGACAACCGUU-5' (SEQ ID NO: 7152)
```

Optionally, the mismatched 'U' residue of position 1 of the antisense strand is alternatively 'G' or 'C'.
LDHA-370 25/27mer DsiRNA, mismatch position=2 of antisense strand (from 5'-terminus)

```
5'-UUGUUGGGGUUGGUGCUGUUGGCat-3'  (SEQ ID NO: 12)
3'-UCAACAACCCCAACCACGACAACCGCA-5' (SEQ ID NO: 7153)
```

Optionally, the mismatched 'C' residue of position 2 of the antisense strand is alternatively 'A' or 'G'.
LDHA-370 25/27mer DsiRNA, mismatch position=3 of antisense strand (from 5'-terminus)

```
5'-UUGUUGGGGUUGGUGCUGUUGGCat-3'  (SEQ ID NO: 12)
3'-UCAACAACCCCAACCACGACAACCUUA-5' (SEQ ID NO: 7154)
```

Optionally, the mismatched 'U' residue of position 3 of the antisense strand is alternatively 'A' or 'C'.
LDHA-370 25/27mer DsiRNA, mismatch position=4 of antisense strand (from 5'-terminus)

```
5'-UUGUUGGGGUUGGUGCUGUUG^GCat-3' (SEQ ID NO: 12)
3'-UCAACAACCCCAACCACGACAAC_AGUA-5' (SEQ ID NO: 7155)
```

Optionally, the mismatched 'A' residue of position 4 of the antisense strand is alternatively 'U' or 'G'.
LDHA-370 25/27mer DsiRNA, mismatch position=5 of antisense strand (from 5'-terminus)

```
5'-UUGUUGGGGUUGGUGCUGUU^GGCat-3' (SEQ ID NO: 12)
3'-UCAACAACCCCAACCACGACAA_UCGUA-5' (SEQ ID NO: 7156)
```

Optionally, the mismatched 'U' residue of position 5 of the antisense strand is alternatively 'A' or 'G'.
LDHA-370 25/27mer DsiRNA, mismatch position=6 of antisense strand (from 5'-terminus)

```
5'-UUGUUGGGGUUGGUGCUGU^UGGCat-3' (SEQ ID NO: 12)
3'-UCAACAACCCCAACCACGACA_UCCGUA-5' (SEQ ID NO: 7157)
```

Optionally, the mismatched 'U' residue of position 6 of the antisense strand is alternatively 'C' or 'G'.
LDHA-370 25/27mer DsiRNA, mismatch position=7 of antisense strand (from 5'-terminus)

```
5'-UUGUUGGGGUUGGUGCUG^UUGGCat-3' (SEQ ID NO: 12)
3'-UCAACAACCCCAACCACGAC_UACCGUA-5' (SEQ ID NO: 7158)
```

Optionally, the mismatched 'U' residue of position 7 of the antisense strand is alternatively 'C' or 'G'.

As another example, in the below structures, such mismatches are introduced within the asymmetric LDHA-402 DsiRNA (newly-introduced mismatch residues are italicized):
LDHA-402 25/27mer DsiRNA, mismatch position=19 of sense strand (from 5'-terminus)

```
5'-GCCAUCAGUAUCUUAAUG^UAGGAct-3' (SEQ ID NO: 7159)
3'-CACGGUAGUCAUAGAAUUAC_UUCCUGA-5' (SEQ ID NO: 90)
```

Optionally, the mismatched 'U' residue of position 19 of the sense strand is alternatively 'C' or 'G'.
LDHA-402 25/27mer DsiRNA, mismatch position=20 of sense strand (from 5'-terminus)

```
5'-GCCAUCAGUAUCUUAAUGA^UGGAct-3' (SEQ ID NO: 7160)
3'-CACGGUAGUCAUAGAAUUACU_UCCUGA-5' (SEQ ID NO: 90)
```

Optionally, the mismatched 'U' residue of position 20 of the sense strand is alternatively 'C' or 'G'.
LDHA-402 25/27mer DsiRNA, mismatch position=21 of sense strand (from 5'-terminus)

```
5'-GCCAUCAGUAUCUUAAUGAA^AGAct-3' (SEQ ID NO: 7161)
3'-CACGGUAGUCAUAGAAUUACUU_CCUGA-5' (SEQ ID NO: 90)
```

Optionally, the mismatched 'A' residue of position 21 of the sense strand is alternatively 'U' or 'C'.
LDHA-402 25/27mer DsiRNA, mismatch position=22 of sense strand (from 5'-terminus)

```
5'-GCCAUCAGUAUCUUAAUGAAGG^UAct-3' (SEQ ID NO: 7162)
3'-CACGGUAGUCAUAGAAUUACUUC_CUGA-5' (SEQ ID NO: 90)
```

Optionally, the mismatched 'U' residue of position 22 of the sense strand is alternatively 'A' or 'C'.
LDHA-402 25/27mer DsiRNA, mismatch position=23 of sense strand (from 5'-terminus)

```
5'-GCCAUCAGUAUCUUAAUGAAGG^Uct-3' (SEQ ID NO: 7163)
3'-CACGGUAGUCAUAGAAUUACUUCC_UGA-5' (SEQ ID NO: 90)
```

Optionally, the mismatched 'U' residue of position 23 of the sense strand is alternatively 'C' or 'G'.
LDHA-402 25/27mer DsiRNA, mismatch position=24 of sense strand (from 5'-terminus)

```
5'-GCCAUCAGUAUCUUAAUGAAGGA^t-3' (SEQ ID NO: 7164)
3'-CACGGUAGUCAUAGAAUUACUUCCU_GA-5' (SEQ ID NO: 90)
```

Optionally, the mismatched 't' residue of position 24 of the sense strand is alternatively 'a' or 'g'.
LDHA-402 25/27mer DsiRNA, mismatch position=25 of sense strand (from 5'-terminus)

```
5'-GCCAUCAGUAUCUUAAUGAAGGAc^a-3' (SEQ ID NO: 7165)
3'-CACGGUAGUCAUAGAAUUACUUCCUG_A-5' (SEQ ID NO: 90)
```

Optionally, the mismatched 'a' residue of position 25 of the sense strand is alternatively 'c' or 'g'.
LDHA-402 25/27mer DsiRNA, mismatch position=1 of antisense strand (from 5'-terminus)

```
5'-GCCAUCAGUAUCUUAAUGAAGGAc^t-3' (SEQ ID NO: 18)
3'-CACGGUAGUCAUAGAAUUACUUCCUG_U-5' (SEQ ID NO: 7166)
```

Optionally, the mismatched 'U' residue of position 1 of the antisense strand is alternatively 'G' or 'C'.
LDHA-402 25/27mer DsiRNA, mismatch position=2 of antisense strand (from 5'-terminus)

```
5'-GCCAUCAGUAUCUUAAUGAAGGA^Ct-3' (SEQ ID NO: 18)
3'-CACGGUAGUCAUAGAAUUACUUCCU_AA-5' (SEQ ID NO: 7167)
```

Optionally, the mismatched 'A' residue of position 2 of the antisense strand is alternatively 'U' or 'C'.
LDHA-402 25/27mer DsiRNA, mismatch position=3 of antisense strand (from 5'-terminus)

```
5'-GCCAUCAGUAUCUUAAUGAAGG^Act-3' (SEQ ID NO: 18)
3'-CACGGUAGUCAUAGAAUUACUUCC_AGA-5' (SEQ ID NO: 7168)
```

Optionally, the mismatched 'A' residue of position 3 of the antisense strand is alternatively 'C' or 'G'.
LDHA-402 25/27mer DsiRNA, mismatch position=4 of antisense strand (from 5'-terminus)

```
5'-GCCAUCAGUAUCUUAAUGAAG^GAct-3' (SEQ ID NO: 18)
3'-CACGGUAGUCAUAGAAUUACUUC_AUGA-5' (SEQ ID NO: 7169)
```

Optionally, the mismatched 'A' residue of position 4 of the antisense strand is alternatively 'U' or 'G'.
LDHA-402 25/27mer DsiRNA, mismatch position=5 of antisense strand (from 5'-terminus)

```
5'-GCCAUCAGUAUCUUAAUGAA^GGAct-3' (SEQ ID NO: 18)
3'-CACGGUAGUCAUAGAAUUACUU_UCUGA-5' (SEQ ID NO: 7170)
```

Optionally, the mismatched 'U' residue of position 5 of the antisense strand is alternatively 'A' or 'G'.
LDHA-402 25/27mer DsiRNA, mismatch position=6 of antisense strand (from 5'-terminus)

```
5'-GCCAUCAGUAUCUUAAUGA^AGGAct-3' (SEQ ID NO: 18)
3'-CACGGUAGUCAUAGAAUUACU_ACCUGA-5' (SEQ ID NO: 7171)
```

Optionally, the mismatched 'A' residue of position 6 of the antisense strand is alternatively 'C' or 'G'.
LDHA-402 25/27mer DsiRNA, mismatch position=7 of antisense strand (from 5'-terminus)

```
5'-GCCAUCAGUAUCUUAAUG^AAGGAct-3' (SEQ ID NO: 18)
3'-CACGGUAGUCAUAGAAUUAC_AUCCUGA-5' (SEQ ID NO: 7172)
```

Optionally, the mismatched 'A' residue of position 7 of the antisense strand is alternatively 'C' or 'G'.
As an additional example, in the below structures, such mismatches are introduced within the asymmetric LDHA-723 DsiRNA (newly-introduced mismatch residues are italicized):
LDHA-723 25/27mer DsiRNA, mismatch position=19 of sense strand (from 5'-terminus)

```
5'-UUGACCUACGUGGCUUGG^UAGAUaa-3'       (SEQ ID NO: 7173)
3'-AGAACUGGAUGCACCGAACC_UUCUAUU-5'     (SEQ ID NO: 99)
```

Optionally, the mismatched 'U' residue of position 19 of the sense strand is alternatively 'C' or 'G'.
LDHA-723 25/27mer DsiRNA, mismatch position=20 of sense strand (from 5'-terminus)

```
5'-UUGACCUACGUGGCUUGGA^UGAUaa-3'       (SEQ ID NO: 7174)
3'-AGAACUGGAUGCACCGAACCU_UCUAUU-5'     (SEQ ID NO: 99)
```

Optionally, the mismatched 'U' residue of position 20 of the sense strand is alternatively 'C' or 'G'.
LDHA-723 25/27mer DsiRNA, mismatch position=21 of sense strand (from 5'-terminus)

```
5'-UUGACCUACGUGGCUUGGAA^AUaa-3'        (SEQ ID NO: 7175)
3'-AGAACUGGAUGCACCGAACCUU_CUAUU-5'     (SEQ ID NO: 99)
```

Optionally, the mismatched 'A' residue of position 21 of the sense strand is alternatively 'U' or 'C'.
LDHA-723 25/27mer DsiRNA, mismatch position=22 of sense strand (from 5'-terminus)

```
5'-UUGACCUACGUGGCUUGGAAG^Uaa-3'        (SEQ ID NO: 7176)
3'-AGAACUGGAUGCACCGAACCUUC_AUU-5'      (SEQ ID NO: 99)
```

Optionally, the mismatched 'G' residue of position 22 of the sense strand is alternatively 'U' or 'C'.
LDHA-723 25/27mer DsiRNA, mismatch position=23 of sense strand (from 5'-terminus)

```
5'-UUGACCUACGUGGCUUGGAAGA^aa-3'        (SEQ ID NO: 7177)
3'-AGAACUGGAUGCACCGAACCUUCU_AUU-5'     (SEQ ID NO: 99)
```

Optionally, the mismatched 'A' residue of position 23 of the sense strand is alternatively 'C' or 'G'.
LDHA-723 25/27mer DsiRNA, mismatch position=24 of sense strand (from 5'-terminus)

```
5'-UUGACCUACGUGGCUUGGAAGAU^a-3'        (SEQ ID NO: 7178)
3'-AGAACUGGAUGCACCGAACCUUCUA_UU-5'     (SEQ ID NO: 99)
```

Optionally, the mismatched 'g' residue of position 24 of the sense strand is alternatively 't' or 'c'.
LDHA-723 25/27mer DsiRNA, mismatch position=25 of sense strand (from 5'-terminus)

```
5'-UUGACCUACGUGGCUUGGAAGAUa^t-3'       (SEQ ID NO: 7179)
3'-AGAACUGGAUGCACCGAACCUUCUAU_u-5'     (SEQ ID NO: 99)
```

Optionally, the mismatched 't' residue of position 25 of the sense strand is alternatively 'c' or 'g'.
LDHA-723 25/27mer DsiRNA, mismatch position=1 of antisense strand (from 5'-terminus)

```
5'-UUGACCUACGUGGCUUGGAAGAUa^a-3'       (SEQ ID NO: 27)
3'-AGAACUGGAUGCACCGAACCUUCUAU_A-5'     (SEQ ID NO: 7180)
```

Optionally, the mismatched 'A' residue of position 1 of the antisense strand is alternatively 'G' or 'C'.
LDHA-723 25/27mer DsiRNA, mismatch position=2 of antisense strand (from 5'-terminus)

5'-UUGACCUACGUGGCUUGGAAGAU$^a$a-3'     (SEQ ID NO: 27)
3'-AGAACUGGAUGCACCGAACCUUCUA$_C$U-5'   (SEQ ID NO: 7181)

Optionally, the mismatched 'C' residue of position 2 of the antisense strand is alternatively 'A' or 'G'.
LDHA-723 25/27mer DsiRNA, mismatch position=3 of antisense strand (from 5'-terminus)

5'-UUGACCUACGUGGCUUGGAAGA$^U$aa-3'     (SEQ ID NO: 27)
3'-AGAACUGGAUGCACCGAACCUUCU$_U$UU-5'   (SEQ ID NO: 7182)

Optionally, the mismatched 'U' residue of position 3 of the antisense strand is alternatively 'C' or 'G'.
LDHA-723 25/27mer DsiRNA, mismatch position=4 of antisense strand (from 5'-terminus)

5'-UUGACCUACGUGGCUUGGAAG$^A$Uaa-3'     (SEQ ID NO: 27)
3'-AGAACUGGAUGCACCGAACCUUC$_G$AUU-5'   (SEQ ID NO: 7183)

Optionally, the mismatched 'C' residue of position 4 of the antisense strand is alternatively 'A' or 'G'.
LDHA-723 25/27mer DsiRNA, mismatch position=5 of antisense strand (from 5'-terminus)

5'-UUGACCUACGUGGCUUGGAA$^G$AUaa-3'     (SEQ ID NO: 27)
3'-AGAACUGGAUGCACCGAACCUU$_U$UAUU-5'   (SEQ ID NO: 7184)

Optionally, the mismatched 'U' residue of position 5 of the antisense strand is alternatively 'A' or 'G'.
LDHA-723 25/27mer DsiRNA, mismatch position=6 of antisense strand (from 5'-terminus)

5'-UUGACCUACGUGGCUUGGA$^A$GAUaa-3'     (SEQ ID NO: 27)
3'-AGAACUGGAUGCACCGAACCU$_A$CUAUU-5'   (SEQ ID NO: 7185)

Optionally, the mismatched 'A' residue of position 6 of the antisense strand is alternatively 'C' or 'G'.
LDHA-723 25/27mer DsiRNA, mismatch position=7 of antisense strand (from 5'-terminus)

5'-UUGACCUACGUGGCUUGG$^A$GAUaa-3'      (SEQ ID NO: 27)
3'-AGAACUGGAUGCACCGAACCU$_A$UCUAUU-5'  (SEQ ID NO: 7186)

Optionally, the mismatched 'A' residue of position 7 of the antisense strand is alternatively 'C' or 'G'.

As noted above, introduction of mismatches can be performed upon any of the DsiRNAs described herein.

The mismatches of such DsiRNA structures can be combined to produce a DsiRNA possessing, e.g., two, three or even four mismatches within the 3'-terminal four to seven nucleotides of the sense strand/5'-terminal four to seven nucleotides of the antisense strand.

Indeed, in view of the flexibility of sequences which can be incorporated into DsiRNAs at the 3'-terminal residues of the sense strand/5'-terminal residues of the antisense strand, in certain embodiments, the sequence requirements of an asymmetric DsiRNA of the instant invention can be represented as the following (minimalist) structure (shown for an exemplary lactate dehydrogenase-1365 DsiRNA sequence):

(SEQ ID NO: 7141)
5'-GUCCUUUUUAUCUGAUCUXXXXXX[X]$_n$-3'

(SEQ ID NO: 7142)
3'-AACAGGAAAAAUAGACUAGAXXXXXX[X]$_n$-5' where n=1 to 5, 1 to 10, 1 to 20, 1 to 30, 1 to 50, or 1 to 80 or more.
lactate dehydrogenase-1365 mRNA Target: 5'-UUGUCCUUUUUAUCUGAUCUXXXXXXX-3' (SEQ ID NO: 7143).

The lactate dehydrogenase target site may also be a site which is targeted by one or more of several oligonucleotides whose complementary target sites overlap with a stated target site. For example, for an exemplary lactate dehydrogenase-1365 DsiRNA, it is noted that certain DsiRNAs targeting overlapping and only slightly offset lactate dehydrogenase sequences could exhibit activity levels similar to that of lactate dehydrogenase-1635 (e.g., lactate dehydrogenase-1359 to 1372 of Table 2 above). Thus, in certain embodiments, a designated target sequence region might be effectively targeted by a series of DsiRNAs possessing largely overlapping sequences. (E.g., if considering DsiRNAs of the lactate dehydrogenase-1359 to lactate dehydrogenase-1372 target site(s), a more encompassing lactate dehydrogenase transcript target sequence might be recited as, e.g., 5'-UGCAUGUUGUCCUUUUUAUCUGAUCUGUGAUUAAAGCAGU-3' (SEQ ID NO: 7144), wherein any given DsiRNA (e.g., a DsiRNA selected from lactate dehydrogenase-1359 to lactate dehydrogenase-1372) only targets a sub-sequence within such a sequence region, yet the entire sequence can be considered a viable target for such a series of DsiRNAs).

Additionally and/or alternatively, mismatches within the 3'-terminal seven nucleotides of the sense strand/5'-terminal seven nucleotides of the antisense strand can be combined with mismatches positioned at other mismatch-tolerant positions, as described above.

In view of the present identification of the above-described Dicer substrate agents (DsiRNAs) as inhibitors of lactate dehydrogenase levels via targeting of specific lactate dehydrogenase sequences, it is also recognized that dsRNAs having structures similar to those described herein can also be synthesized which target other sequences within the lactate dehydrogenase sequence of NM_005566.3, or within variants thereof (e.g., target sequences possessing 80% identity, 90% identity, 95% identity, 96% identity, 97% identity, 98% identity, 99% or more identity to a sequence of NM_005566.3).

Anti-Lactate Dehydrogenase DsiRNA Design/Synthesis

It has been found empirically that longer dsRNA species of from 25 to 35 nucleotides (DsiRNAs) and especially from 25 to 30 nucleotides give unexpectedly effective results in terms of potency and duration of action, as compared to 19-23mer siRNA agents. Without wishing to be bound by the underlying theory of the dsRNA processing mechanism, it is thought that the longer dsRNA species serve as a substrate for the Dicer enzyme in the cytoplasm of a cell. In addition to cleaving the dsRNA of the invention into shorter segments, Dicer is thought to facilitate the incorporation of a single-stranded cleavage product derived from the cleaved dsRNA into the RISC complex that is responsible for the destruction of the cytoplasmic RNA (e.g., lactate dehydrogenase RNA) of or derived from the target gene, lactate dehydrogenase (or other gene associated with a lactate dehydrogenase-associated disease or disorder). Prior studies (Rossi et al., U.S. Patent Application No. 2007/0265220) have shown that the cleavability of a dsRNA species (specifically, a DsiRNA agent) by Dicer corresponds with increased potency and duration of action of the dsRNA species.

Certain preferred anti-lactate dehydrogenase DsiRNA agents were selected from a pre-screened population. Design of DsiRNAs can optionally involve use of predictive scoring algorithms that perform in silico assessments of the projected activity/efficacy of a number of possible DsiRNA agents spanning a region of sequence. Information regarding the design of such scoring algorithms can be found, e.g., in Gong et al. (*BMC Bioinformatics* 2006, 7:516), though a more recent "v4.3" algorithm represents a theoretically improved algorithm relative to siRNA scoring algorithms previously available in the art. (E.g., "v3" and "v4" scoring algorithms are machine learning algorithms that are not reliant upon any biases in human sequence. In addition, the "v3" and "v4" algorithms derive from data sets that are many-fold larger than that from which an older "v2" algorithm such as that described in Gong et al. derives.)

The first and second oligonucleotides of the DsiRNA agents of the instant invention are not required to be completely complementary. In fact, in one embodiment, the 3'-terminus of the sense strand contains one or more mismatches. In one aspect, two mismatches are incorporated at the 3' terminus of the sense strand. In another embodiment, the DsiRNA of the invention is a double stranded RNA molecule containing two RNA oligonucleotides each of which is 27 nucleotides in length and, when annealed to each other, have blunt ends and a two nucleotide mismatch on the 3'-terminus of the sense strand (the 5'-terminus of the antisense strand). The use of mismatches or decreased thermodynamic stability (specifically at the 3'-sense/5'-antisense position) has been proposed to facilitate or favor entry of the antisense strand into RISC (Schwarz et al., 2003, *Cell* 115: 199-208; Khvorova et al., 2003, *Cell* 115: 209-216), presumably by affecting some rate-limiting unwinding steps that occur with entry of the siRNA into RISC. Thus, terminal base composition has been included in design algorithms for selecting active 21mer siRNA duplexes (Ui-Tei et al., 2004, *Nucleic Acids Res* 32: 936-948; Reynolds et al., 2004, *Nat Biotechnol* 22: 326-330). With Dicer cleavage of the dsRNA of this embodiment, the small end-terminal sequence which contains the mismatches will either be left unpaired with the antisense strand (become part of a 3'-overhang) or be cleaved entirely off the final 21-mer siRNA. These "mismatches", therefore, do not persist as mismatches in the final RNA component of RISC. The finding that base mismatches or destabilization of segments at the 3'-end of the sense strand of Dicer substrate improved the potency of synthetic duplexes in RNAi, presumably by facilitating processing by Dicer, was a surprising finding of past works describing the design and use of 25-30mer dsRNAs (also termed "DsiRNAs" herein; Rossi et al., U.S. Patent Application Nos. 2005/0277610, 2005/0244858 and 2007/0265220).

Modification of Anti-Lactate Dehydrogenase dsRNAs

One major factor that inhibits the effect of double stranded RNAs ("dsRNAs") is the degradation of dsRNAs (e.g., siRNAs and DsiRNAs) by nucleases. A 3'-exonuclease is the primary nuclease activity present in serum and modification of the 3'-ends of antisense DNA oligonucleotides is crucial to prevent degradation (Eder et al., 1991, *Antisense Res Dev*, 1: 141-151). An RNase-T family nuclease has been identified called ERI-1 which has 3' to 5' exonuclease activity that is involved in regulation and degradation of siRNAs (Kennedy et al., 2004, *Nature* 427: 645-649; Hong et al., 2005, *Biochem J*, 390: 675-679). This gene is also known as Thex1 (NM_02067) in mice or THEX1 (NM_153332) in humans and is involved in degradation of histone mRNA; it also mediates degradation of 3'-overhangs in siRNAs, but does not degrade duplex RNA (Yang et al., 2006, *J Biol Chem*, 281: 30447-30454). It is therefore reasonable to expect that 3'-end-stabilization of dsRNAs, including the DsiRNAs of the instant invention, will improve stability.

XRN1 (NM_019001) is a 5' to 3' exonuclease that resides in P-bodies and has been implicated in degradation of mRNA targeted by miRNA (Rehwinkel et al., 2005, *RNA* 11: 1640-1647) and may also be responsible for completing degradation initiated by internal cleavage as directed by a siRNA. XRN2 (NM_012255) is a distinct 5' to 3' exonuclease that is involved in nuclear RNA processing.

RNase A is a major endonuclease activity in mammals that degrades RNAs. It is specific for ssRNA and cleaves at the 3'-end of pyrimidine bases. SiRNA degradation products consistent with RNase A cleavage can be detected by mass spectrometry after incubation in serum (Turner et al., 2007, *Mol Biosyst* 3: 43-50). The 3'-overhangs enhance the susceptibility of siRNAs to RNase degradation. Depletion of RNase A from serum reduces degradation of siRNAs; this degradation does show some sequence preference and is worse for sequences having poly A/U sequence on the ends (Haupenthal et al., 2006 *Biochem Pharmacol* 71: 702-710). This suggests the possibility that lower stability regions of the duplex may "breathe" and offer transient single-stranded species available for degradation by RNase A. RNase A inhibitors can be added to serum and improve siRNA longevity and potency (Haupenthal et al., 2007, *Int J. Cancer* 121: 206-210).

In 21mers, phosphorothioate or boranophosphate modifications directly stabilize the internucleoside phosphate linkage. Boranophosphate modified RNAs are highly nuclease resistant, potent as silencing agents, and are relatively non-toxic. Boranophosphate modified RNAs cannot be manufactured using standard chemical synthesis methods and instead are made by in vitro transcription (IVT) (Hall et al., 2004, *Nucleic Acids Res* 32: 5991-6000; Hall et al., 2006, *Nucleic Acids Res* 34: 2773-2781). Phosphorothioate (PS) modifications can be easily placed in the RNA duplex at any desired position and can be made using standard chemical synthesis methods. The PS modification shows dose-dependent toxicity, so most investigators have recommended limited incorporation in siRNAs, favoring the 3'-ends where protection from nucleases is most important (Harborth et al., 2003, *Antisense Nucleic Acid Drug Dev* 13: 83-105; Chiu and Rana, 2003, *Mol Cell* 10: 549-561; Braasch et al., 2003, *Biochemistry* 42: 7967-7975; Amarzguioui et al., 2003, *Nucleic Acids Research* 31: 589-595). More extensive PS modification can be compatible with potent RNAi activity; however, use of sugar modifications (such as 2'-O-methyl RNA) may be superior (Choung et al., 2006, *Biochem Biophys Res Commun* 342: 919-927).

A variety of substitutions can be placed at the 2'-position of the ribose which generally increases duplex stability ($T_m$) and can greatly improve nuclease resistance. 2'-O-methyl RNA is a naturally occurring modification found in mammalian ribosomal RNAs and transfer RNAs. 2'-O-methyl modification in siRNAs is known, but the precise position of modified bases within the duplex is important to retain potency and complete substitution of 2'-O-methyl RNA for RNA will inactivate the siRNA. For example, a pattern that employs alternating 2'-O-methyl bases can have potency equivalent to unmodified RNA and is quite stable in serum (Choung et al., 2006, *Biochem Biophys Res Commun* 342: 919-927; Czauderna et al., 2003, *Nucleic Acids Research* 31: 2705-2716).

The 2'-fluoro (2'-F) modification is also compatible with dsRNA (e.g., siRNA and DsiRNA) function; it is most commonly placed at pyrimidine sites (due to reagent cost and availability) and can be combined with 2'-O-methyl modification at purine positions; 2'-F purines are available and can also be used. Heavily modified duplexes of this kind can be potent triggers of RNAi in vitro (Allerson et al., 2005, *J Med Chem* 48: 901-904; Prakash et al., 2005, *J Med Chem* 48: 4247-4253; Kraynack and Baker, 2006, *RNA* 12: 163-176) and can improve performance and extend duration of action when used in vivo (Morrissey et al., 2005, *Hepatology* 41: 1349-1356; Morrissey et al., 2005, *Nat Biotechnol* 23: 1002-1007). A highly potent, nuclease stable, blunt 19mer duplex containing alternative 2'-F and 2'-O-Me bases is taught by Allerson. In this design, alternating 2'-O-Me residues are positioned in an identical pattern to that employed by Czauderna, however the remaining RNA residues are converted to 2'-F modified bases. A highly potent, nuclease resistant siRNA employed by Morrissey employed a highly potent, nuclease resistant siRNA in vivo. In addition to 2'-O-Me RNA and 2'-F RNA, this duplex includes DNA, RNA, inverted abasic residues, and a 3'-terminal PS internucleoside linkage. While extensive modification has certain benefits, more limited modification of the duplex can also improve in vivo performance and is both simpler and less costly to manufacture. Soutschek et al. (2004, *Nature* 432: 173-178) employed a duplex in vivo and was mostly RNA with two 2'-O-Me RNA bases and limited 3'-terminal PS internucleoside linkages.

Locked nucleic acids (LNAs) are a different class of 2'-modification that can be used to stabilize dsRNA (e.g., siRNA and DsiRNA). Patterns of LNA incorporation that retain potency are more restricted than 2'-O-methyl or 2'-F bases, so limited modification is preferred (Braasch et al., 2003, *Biochemistry* 42: 7967-7975; Grunweller et al., 2003, *Nucleic Acids Res* 31: 3185-3193; Elmen et al., 2005, *Nucleic Acids Res* 33: 439-447). Even with limited incorporation, the use of LNA modifications can improve dsRNA performance in vivo and may also alter or improve off target effect profiles (Mook et al., 2007, *Mol Cancer Ther* 6: 833-843).

Synthetic nucleic acids introduced into cells or live animals can be recognized as "foreign" and trigger an immune response. Immune stimulation constitutes a major class of off-target effects which can dramatically change experimental results and even lead to cell death. The innate immune system includes a collection of receptor molecules that specifically interact with DNA and RNA that mediate these responses, some of which are located in the cytoplasm and some of which reside in endosomes (Marques and Williams, 2005, *Nat Biotechnol* 23: 1399-1405; Schlee et al., 2006, *Mol Ther* 14: 463-470). Delivery of siRNAs by cationic lipids or liposomes exposes the siRNA to both cytoplasmic and endosomal compartments, maximizing the risk for triggering a type 1 interferon (IFN) response both in vitro and in vivo (Morrissey et al., 2005, *Nat Biotechnol* 23: 1002-1007; Sioud and Sorensen, 2003, *Biochem Biophys Res Commun* 312: 1220-1225; Sioud, 2005, *J Mol Biol* 348: 1079-1090; Ma et al., 2005, *Biochem Biophys Res Commun* 330: 755-759). RNAs transcribed within the cell are less immunogenic (Robbins et al., 2006, *Nat Biotechnol* 24: 566-571) and synthetic RNAs that are immunogenic when delivered using lipid-based methods can evade immune stimulation when introduced unto cells by mechanical means, even in vivo (Heidel et al., 2004, *Nat Biotechnol* 22: 1579-1582). However, lipid based delivery methods are convenient, effective, and widely used. Some general strategy to prevent immune responses is needed, especially for in vivo application where all cell types are present and the risk of generating an immune response is highest. Use of chemically modified RNAs may solve most or even all of these problems.

In certain embodiments, modifications can be included in the anti-lactate dehydrogenase dsRNA agents of the present invention so long as the modification does not prevent the dsRNA agent from possessing lactate dehydrogenase inhibitory activity. In one embodiment, one or more modifications are made that enhance Dicer processing of the DsiRNA agent (an assay for determining Dicer processing of a DsiRNA is described elsewhere herein). In a second embodiment, one or more modifications are made that result in more effective lactate dehydrogenase inhibition (as described herein, lactate dehydrogenase inhibition/lactate dehydrogenase inhibitory activity of a dsRNA can be assayed via art-recognized methods for determining RNA levels, or for determining lactate dehydrogenase polypeptide levels, should such levels be assessed in lieu of or in addition to assessment of, e.g., lactate dehydrogenase mRNA levels). In a third embodiment, one or more modifications are made that support greater lactate dehydrogenase inhibitory activity (means of determining lactate dehydrogenase inhibitory activity are described supra). In a fourth embodiment, one or more modifications are made that result in greater potency of lactate dehydrogenase inhibitory activity per each dsRNA agent molecule to be delivered to the cell (potency of lactate dehydrogenase inhibitory activity is described supra). Modifications can be incorporated in the 3'-terminal region, the 5'-terminal region, in both the 3'-terminal and 5'-terminal region or in some instances in various positions within the sequence. With the restrictions noted above in mind, numbers and combinations of modifications can be incorporated into the dsRNA agent. Where multiple modifications are present, they may be the same or different. Modifications to bases, sugar moieties, the phosphate backbone, and their combinations are contemplated. Either 5'-terminus can be phosphorylated.

Examples of modifications contemplated for the phosphate backbone include phosphonates, including methylphosphonate, phosphorothioate, and phosphotriester modifications such as alkylphosphotriesters, and the like. Examples of modifications contemplated for the sugar moiety include 2'-alkyl pyrimidine, such as 2'-O-methyl, 2'-fluoro, amino, and deoxy modifications and the like (see, e.g., Amarzguioui et al., 2003, *Nucleic Acids Research* 31: 589-595). Examples of modifications contemplated for the base groups include abasic sugars, 2-O-alkyl modified pyrimidines, 4-thiouracil, 5-bromouracil, 5-iodouracil, and 5-(3-aminoallyl)-uracil and the like. Locked nucleic acids, or LNA's, could also be incorporated. Many other modifications are known and can be used so long as the above criteria are satisfied. Examples of modifications are also disclosed in U.S. Pat. Nos. 5,684,143, 5,858,988 and 6,291,438 and in U.S. published patent application No. 2004/0203145 A1. Other modifications are disclosed in Herdewijn (2000, *Antisense Nucleic Acid Drug Dev* 10: 297-310), Eckstein (2000, *Antisense Nucleic Acid Drug Dev* 10: 117-21), Rusckowski et al. (2000, *Antisense Nucleic Acid Drug Dev* 10: 333-345), Stein et al. (2001, *Antisense Nucleic Acid Drug Dev* 11: 317-25); Vorobjev et al. (2001, *Antisense Nucleic Acid Drug Dev* 11: 77-85).

One or more modifications contemplated can be incorporated into either strand. The placement of the modifications in the dsRNA agent can greatly affect the characteristics of the dsRNA agent, including conferring greater potency and stability, reducing toxicity, enhance Dicer processing, and minimizing an immune response. In one embodiment, the antisense strand or the sense strand or both strands have one or more 2'-O-methyl modified nucleotides. In another embodiment, the antisense strand contains 2'-O-methyl modified nucleotides. In another embodiment, the antisense stand contains a 3' overhang that is comprised of 2'-O-methyl modified nucleotides. The antisense strand could also include additional 2'-O-methyl modified nucleotides.

In certain embodiments, the anti-lactate dehydrogenase DsiRNA agent of the invention has several properties which enhance its processing by Dicer. According to such embodiments, the DsiRNA agent has a length sufficient such that it is processed by Dicer to produce an siRNA and at least one of the following properties: (i) the DsiRNA agent is asymmetric, e.g., has a 3' overhang on the sense strand and (ii) the DsiRNA agent has a modified 3' end on the antisense strand to direct orientation of Dicer binding and processing of the dsRNA to an active siRNA. According to these embodiments, the longest strand in the DsiRNA agent comprises 25-30 nucleotides. In one embodiment, the sense strand comprises 25-30 nucleotides and the antisense strand comprises 25-28 nucleotides. Thus, the resulting dsRNA has an overhang on the 3' end of the sense strand. The overhang is 1-4 nucleotides, such as 2 nucleotides. The antisense strand may also have a 5' phosphate.

In certain embodiments, the sense strand of a DsiRNA agent is modified for Dicer processing by suitable modifiers located at the 3' end of the sense strand, i.e., the DsiRNA agent is designed to direct orientation of Dicer binding and processing. Suitable modifiers include nucleotides such as deoxyribonucleotides, dideoxyribonucleotides, acyclonucleotides and the like and sterically hindered molecules, such as fluorescent molecules and the like. Acyclonucleotides substitute a 2-hydroxyethoxymethyl group for the 2'-deoxyribofuranosyl sugar normally present in dNMPs. Other nucleotide modifiers could include 3'-deoxyadenosine (cordycepin), 3'-azido-3'-deoxythymidine (AZT), 2',3'-dideoxyinosine (ddI), 2',3'-dideoxy-3'-thiacytidine (3TC), 2',3'-didehydro-2',3'-dideoxythymidine (d4T) and the monophosphate nucleotides of 3'-azido-3'-deoxythymidine (AZT), 2',3'-dideoxy-3'-thiacytidine (3TC) and 2',3'-didehydro-2',3'-dideoxythymidine (d4T). In one embodiment, deoxynucleotides are used as the modifiers. When nucleotide modifiers are utilized, 1-3 nucleotide modifiers, or 2 nucleotide modifiers are substituted for the ribonucleotides on the 3' end of the sense strand. When sterically hindered molecules are utilized, they are attached to the ribonucleotide at the 3' end of the antisense strand. Thus, the length of the strand does not change with the incorporation of the modifiers. In another embodiment, the invention contemplates substituting two DNA bases in the dsRNA to direct the orientation of Dicer processing. In a further invention, two terminal DNA bases are located on the 3' end of the sense strand in place of two ribonucleotides forming a blunt end of the duplex on the 5' end of the antisense strand and the 3' end of the sense strand, and a two-nucleotide RNA overhang is located on the 3'-end of the antisense strand. This is an asymmetric composition with DNA on the blunt end and RNA bases on the overhanging end.

In certain other embodiments, the antisense strand of a DsiRNA agent is modified for Dicer processing by suitable modifiers located at the 3' end of the antisense strand, i.e., the DsiRNA agent is designed to direct orientation of Dicer binding and processing. Suitable modifiers include nucleotides such as deoxyribonucleotides, dideoxyribonucleotides, acyclonucleotides and the like and sterically hindered molecules, such as fluorescent molecules and the like. Acyclonucleotides substitute a 2-hydroxyethoxymethyl group for the 2'-deoxyribofuranosyl sugar normally present in dNMPs. Other nucleotide modifiers could include 3'-deoxyadenosine (cordycepin), 3'-azido-3'-deoxythymidine (AZT), 2',3'-dideoxyinosine (ddI), 2',3'-dideoxy-3'-thiacytidine (3TC), 2',3'-didehydro-2',3'-dideoxythymidine (d4T) and the monophosphate nucleotides of 3'-azido-3'-deoxythymidine (AZT), 2',3'-dideoxy-3'-thiacytidine (3TC) and 2',3'-didehydro-2',3'-dideoxythymidine (d4T). In one embodiment, deoxynucleotides are used as the modifiers. When nucleotide modifiers are utilized, 1-3 nucleotide modifiers, or 2 nucleotide modifiers are substituted for the ribonucleotides on the 3' end of the antisense strand. When sterically hindered molecules are utilized, they are attached to the ribonucleotide at the 3' end of the antisense strand. Thus, the length of the strand does not change with the incorporation of the modifiers. In another embodiment, the invention contemplates substituting two DNA bases in the dsRNA to direct the orientation of Dicer processing. In a further invention, two terminal DNA bases are located on the 3' end of the antisense strand in place of two ribonucleotides forming a blunt end of the duplex on the 5' end of the sense strand and the 3' end of the antisense strand, and a two-nucleotide RNA overhang is located on the 3'-end of the sense strand. This is also an asymmetric composition with DNA on the blunt end and RNA bases on the overhanging end.

The sense and antisense strands anneal under biological conditions, such as the conditions found in the cytoplasm of a cell. In addition, a region of one of the sequences, particularly of the antisense strand, of the dsRNA has a sequence length of at least 19 nucleotides, wherein these nucleotides are adjacent to the 3' end of antisense strand and are sufficiently complementary to a nucleotide sequence of the target lactate dehydrogenase RNA.

Additionally, the DsiRNA agent structure can be optimized to ensure that the oligonucleotide segment generated from Dicer's cleavage will be the portion of the oligonucleotide that is most effective in inhibiting gene expression. For example, in one embodiment of the invention, a 27-bp oligonucleotide of the DsiRNA agent structure is synthesized wherein the anticipated 21 to 22-bp segment that will inhibit gene expression is located on the 3'-end of the antisense strand. The remaining bases located on the 5'-end of the antisense strand will be cleaved by Dicer and will be discarded. This cleaved portion can be homologous (i.e., based on the sequence of the target sequence) or non-homologous and added to extend the nucleic acid strand.

US 2007/0265220 discloses that 27mer DsiRNAs showed improved stability in serum over comparable 21mer siRNA compositions, even absent chemical modification. Modifications of DsiRNA agents, such as inclusion of 2'-O-methyl RNA in the antisense strand, in patterns such as detailed above, when coupled with addition of a 5' Phosphate, can improve stability of DsiRNA agents. Addition of 5'-phosphate to all strands in synthetic RNA duplexes may be an inexpensive and physiological method to confer some limited degree of nuclease stability.

The chemical modification patterns of the dsRNA agents of the instant invention are designed to enhance the efficacy of such agents. Accordingly, such modifications are designed to avoid reducing potency of dsRNA agents; to avoid interfering with Dicer processing of DsiRNA agents; to improve stability in biological fluids (reduce nuclease sensitivity) of dsRNA agents; or to block or evade detection by the innate immune system. Such modifications are also designed to avoid being toxic and to avoid increasing the cost or impact the ease of manufacturing the instant dsRNA agents of the invention.

In certain embodiments of the present invention, an anti-lactate dehydrogenase DsiRNA agent has one or more of the following properties: (i) the DsiRNA agent is asymmetric, e.g., has a 3' overhang on the antisense strand and (ii) the DsiRNA agent has a modified 3' end on the sense strand to direct orientation of Dicer binding and processing of the dsRNA to an active siRNA. According to this embodiment, the longest strand in the dsRNA comprises 25-35 nucleotides (e.g., 25, 26, 27, 28, 29, 30, 31, 32, 33, 34 or 35 nucleotides). In certain such embodiments, the DsiRNA agent is asymmetric such that the sense strand comprises 25-34 nucleotides and the 3' end of the sense strand forms a blunt end with the 5' end of the antisense strand while the antisense strand comprises 26-35 nucleotides and forms an overhang on the 3' end of the antisense strand. In one embodiment, the DsiRNA agent is asymmetric such that the sense strand comprises 25-28 nucleotides and the antisense strand comprises 25-30 nucleotides. Thus, the resulting dsRNA has an overhang on the 3' end of the antisense strand. The overhang is 1-4 nucleotides, for example 2 nucleotides. The sense strand may also have a 5' phosphate.

The DsiRNA agent can also have one or more of the following additional properties: (a) the antisense strand has a right shift from the typical 21mer (e.g., the DsiRNA comprises a length of antisense strand nucleotides that extends to the 5' of a projected Dicer cleavage site within the DsiRNA, with such antisense strand nucleotides base paired with corresponding nucleotides of the sense strand extending 3' of a projected Dicer cleavage site in the sense strand), (b) the strands may not be completely complementary, i.e., the strands may contain simple mismatched base pairs (in certain embodiments, the DsiRNAs of the invention possess 1, 2, 3, 4 or even 5 or more mismatched base pairs, provided that lactate dehydrogenase inhibitory activity of the DsiRNA possessing mismatched base pairs is retained at sufficient levels (e.g., retains at least 50% lactate dehydrogenase inhibitory activity or more, at least 60% lactate dehydrogenase inhibitory activity or more, at least 70% lactate dehydrogenase inhibitory activity or more, at least 80% lactate dehydrogenase inhibitory activity or more, at least 90% lactate dehydrogenase inhibitory activity or more or at least 95% lactate dehydrogenase inhibitory activity or more as compared to a corresponding DsiRNA not possessing mismatched base pairs. In certain embodiments, mismatched base pairs exist between the antisense and sense strands of a DsiRNA. In some embodiments, mismatched base pairs exist (or are predicted to exist) between the antisense strand and the target RNA. In certain embodiments, the presence of a mismatched base pair(s) between an antisense strand residue and a corresponding residue within the target RNA that is located 3' in the target RNA sequence of a projected Ago2 cleavage site retains and may even enhance lactate dehydrogenase inhibitory activity of a DsiRNA of the invention) and (c) base modifications such as locked nucleic acid(s) may be included in the 5' end of the sense strand. A "typical" 21mer siRNA is designed using conventional techniques. In one technique, a variety of sites are commonly tested in parallel or pools containing several distinct siRNA duplexes specific to the same target with the hope that one of the reagents will be effective (Ji et al., 2003, *FEBS Lett* 552: 247-252). Other techniques use design rules and algorithms to increase the likelihood of obtaining active RNAi effector molecules (Schwarz et al., 2003, *Cell* 115: 199-208; Khvorova et al., 2003, *Cell* 115: 209-216; Ui-Tei et al., 2004, *Nucleic Acids Res* 32: 936-948; Reynolds et al., 2004, *Nat Biotechnol* 22: 326-330; Krol et al., 2004, *J Biol Chem* 279: 42230-42239; Yuan et al., 2004, *Nucl Acids Res* 32 (Webserver issue):W130-134; Boese et al., 2005, *Methods Enzymol* 392: 73-96). High throughput selection of siRNA has also been developed (U.S. published patent application No. 2005/0042641 A1). Potential target sites can also be analyzed by secondary structure predictions (Heale et al., 2005, *Nucleic Acids Res* 33(3): e30). This 21mer is then used to design a right shift to include 3-9 additional nucleotides on the 5' end of the 21mer. The sequence of these additional nucleotides is not restricted. In one embodiment, the added ribonucleotides are based on the sequence of the target gene. Even in this embodiment, full complementarity between the target sequence and the antisense siRNA is not required.

The first and second oligonucleotides of a DsiRNA agent of the instant invention are not required to be completely complementary. They only need to be sufficiently complementary to anneal under biological conditions and to provide a substrate for Dicer that produces a siRNA sufficiently complementary to the target sequence. Locked nucleic acids, or LNA's, are well known to a skilled artisan (Elmen et al., 2005, *Nucleic Acids Res* 33: 439-447; Kurreck et al., 2002, *Nucleic Acids Res* 30: 1911-1918; Crinelli et al., 2002, *Nucleic Acids Res* 30: 2435-2443; Braasch and Corey, 2001, *Chem Biol* 8: 1-7; Bondensgaard et al., 2000, *Chemistry* 6: 2687-2695; Wahlestedt et al., 2000, *Proc Natl Acad Sci USA* 97: 5633-5638). In one embodiment, an LNA is incorporated at the 5' terminus of the sense strand. In another embodiment, an LNA is incorporated at the 5' terminus of the sense strand in duplexes designed to include a 3' overhang on the antisense strand.

In certain embodiments, the DsiRNA agent of the instant invention has an asymmetric structure, with the sense strand having a 25-base pair length, and the antisense strand having a 27-base pair length with a 2 base 3'-overhang. In other embodiments, this DsiRNA agent having an asymmetric structure further contains 2 deoxynucleotides at the 3' end of the sense strand in place of two of the ribonucleotides.

Certain DsiRNA agent compositions containing two separate oligonucleotides can be linked by a third structure. The third structure will not block Dicer activity on the DsiRNA agent and will not interfere with the directed destruction of the RNA transcribed from the target gene. In one embodiment, the third structure may be a chemical linking group. Many suitable chemical linking groups are known in the art and can be used. Alternatively, the third structure may be an oligonucleotide that links the two oligonucleotides of the DsiRNA agent in a manner such that a hairpin structure is produced upon annealing of the two oligonucleotides making up the dsRNA composition. The hairpin structure will not block Dicer activity on the DsiRNA agent and will not interfere with the directed destruction of the lactate dehydrogenase RNA.

In Vitro Assay to Assess dsRNA Lactate Dehydrogenase Inhibitory Activity

An in vitro assay that recapitulates RNAi in a cell-free system can be used to evaluate dsRNA constructs targeting lactate dehydrogenase RNA sequence(s), and thus to assess lactate dehydrogenase-specific gene inhibitory activity (also referred to herein as lactate dehydrogenase inhibitory activity) of a dsRNA. The assay comprises the system described by Tuschl et al., 1999, Genes and Development, 13, 3191-3197 and Zamore et al., 2000, Cell, 101, 25-33 adapted for use with dsRNA (e.g., DsiRNA) agents directed against lactate dehydrogenase RNA. A *Drosophila* extract derived from syncytial blastoderm is used to reconstitute RNAi activity in vitro. Target RNA is generated via in vitro transcription from a selected lactate dehydrogenase expressing plasmid using T7 RNA polymerase or via chemical synthesis. Sense and antisense dsRNA strands (for example, 20 uM each) are annealed by incubation in buffer (such as 100 mM potassium acetate, 30 mM HEPES-KOH, pH 7.4, 2 mM magnesium acetate) for 1 minute at 90° C. followed by 1 hour at 37° C., then diluted in lysis buffer (for example 100 mM potassium acetate, 30 mM HEPES-KOH at pH 7.4, 2 mM magnesium acetate). Annealing can be monitored by gel electrophoresis on an agarose gel in TBE buffer and stained with ethidium bromide. The *Drosophila* lysate is prepared using zero to two-hour-old embryos from Oregon R flies collected on yeasted molasses agar that are dechorionated and lysed. The lysate is centrifuged and the supernatant isolated. The assay comprises a reaction mixture containing 50% lysate [vol/vol], RNA (10-50 pM final concentration), and 10% [vol/vol] lysis buffer containing dsRNA (10 nM final concentration). The reaction mixture also contains 10 mM creatine phosphate, 10 ug/ml creatine phosphokinase, 100 um GTP, 100 uM UTP, 100 uM CTP, 500 uM ATP, 5 mM DTT, 0.1 U/uL RNasin (Promega), and 100 uM of each amino acid. The final concentration of potassium acetate is adjusted to 100 mM. The reactions are pre-assembled on ice and preincubated at 25° C. for 10 minutes before adding RNA, then incubated at 25° C. for an additional 60 minutes. Reactions are quenched with 4 volumes of 1.25× Passive Lysis Buffer (Promega). Target RNA cleavage is assayed by RT-PCR analysis or other methods known in the art and are compared to control reactions in which dsRNA is omitted from the reaction.

Alternately, internally-labeled target RNA for the assay is prepared by in vitro transcription in the presence of [$\alpha$-$^{32}$P] CTP, passed over a G50 Sephadex column by spin chromatography and used as target RNA without further purification. Optionally, target RNA is 5'-$^{32}$P-end labeled using T4 polynucleotide kinase enzyme. Assays are performed as described above and target RNA and the specific RNA cleavage products generated by RNAi are visualized on an autoradiograph of a gel. The percentage of cleavage is determined by PHOSPHOR IMAGER® (autoradiography) quantitation of bands representing intact control RNA or RNA from control reactions without dsRNA and the cleavage products generated by the assay.

In one embodiment, this assay is used to determine target sites in the lactate dehydrogenase RNA target for dsRNA mediated RNAi cleavage, wherein a plurality of dsRNA constructs are screened for RNAi mediated cleavage of the lactate dehydrogenase RNA target, for example, by analyzing the assay reaction by electrophoresis of labeled target RNA, or by northern blotting, as well as by other methodology well known in the art.

In certain embodiments, a dsRNA of the invention is deemed to possess lactate dehydrogenase inhibitory activity if, e.g., a 50% reduction in lactate dehydrogenase RNA levels is observed in a system, cell, tissue or organism, relative to a suitable control. Additional metes and bounds for determination of lactate dehydrogenase inhibitory activity of a dsRNA of the invention are described supra.

Conjugation and Delivery of Anti-Lactate Dehydrogenase dsRNA Agents

In certain embodiments the present invention relates to a method for treating a subject having oxalate accumulation, PH1 and/or other lactate dehydrogenase-associated disease or disorder, or is at risk of developing oxalate accumulation, PH1 and/or other lactate dehydrogenase-associated disease or disorder. In such embodiments, the dsRNA can act as novel therapeutic agents for controlling the oxalate accumulation, PH1 and/or other lactate dehydrogenase-associated disease or disorder. The method comprises administering a pharmaceutical composition of the invention to the patient (e.g., human), such that the expression, level and/or activity of a lactate dehydrogenase RNA is reduced. The expression, level and/or activity of a polypeptide encoded by a lactate dehydrogenase RNA might also be reduced by a dsRNA of the instant invention, even where said dsRNA is directed against a non-coding region of the lactate dehydrogenase transcript (e.g., a targeted 5' UTR or 3' UTR sequence). Because of their high specificity, the dsRNAs of the present invention can specifically target lactate dehydrogenase sequences of cells and tissues, optionally in an allele-specific manner where polymorphic alleles exist within an individual and/or population.

In the treatment of oxalate accumulation, PH1 and/or other lactate dehydrogenase-associated disease or disorder, the dsRNA can be brought into contact with the cells or tissue of a subject, e.g., the cells or tissue of a subject targeted for reduction of lactate dehydrogenase levels. For a disease such as PH1 or other disease or disorder of oxalate accumulation treatable or preventable via administration of an anti-LDHA agent (e.g., a dsRNA of the invention), targeted inhibition of LDHA preferentially delivered to the liver can be performed via use of dsRNA therapeutics such as those disclosed herein and delivery modalities for dsRNA known in the art (e.g., lipid nanoparticles and other moieties that preferentially deliver dsRNA to the liver). For example, dsRNA substantially identical to all or part of a lactate dehydrogenase RNA sequence, may be brought into contact with or introduced into such a cell, either in vivo or in vitro. Similarly, dsRNA substantially identical to all or part of a lactate dehydrogenase RNA sequence may administered directly to a subject having or at risk of developing a disease or disorder that could be prevented or treated via administration of an anti-LDHA agent.

Therapeutic use of the dsRNA agents of the instant invention can involve use of formulations of dsRNA agents comprising multiple different dsRNA agent sequences. For example, two or more, three or more, four or more, five or more, etc. of the presently described agents can be combined to produce a formulation that, e.g., targets multiple different regions of the lactate dehydrogenase RNA, or that not only target lactate dehydrogenase RNA but also target, e.g., cellular target genes associated with a lactate dehydrogenase-associated disease or disorder. A dsRNA agent of the instant invention may also be constructed such that either strand of the dsRNA agent independently targets two or more regions of lactate dehydrogenase RNA, or such that one of the strands of the dsRNA agent targets a cellular target gene of lactate dehydrogenase known in the art.

Use of multifunctional dsRNA molecules that target more then one region of a target nucleic acid molecule can also provide potent inhibition of lactate dehydrogenase RNA levels and expression. For example, a single multifunctional dsRNA construct of the invention can target both the lactate dehydrogenase-402 and lactate dehydrogenase-723 sites simultaneously; additionally and/or alternatively, single or multifunctional agents of the invention can be designed to selectively target one splice variant of lactate dehydrogenase over another.

Thus, the dsRNA agents of the instant invention, individually, or in combination or in conjunction with other drugs, can be used to treat, inhibit, reduce, or prevent a lactate dehydrogenase-associated disease or disorder. For example, the dsRNA molecules can be administered to a subject or can be administered to other appropriate cells evident to those skilled in the art, individually or in combination with one or more drugs under conditions suitable for the treatment.

The dsRNA molecules also can be used in combination with other known treatments to treat, inhibit, reduce, or prevent PH1 or other lactate dehydrogenase-associated disease or disorder in a subject or organism. For example, the described molecules could be used in combination with one or more known compounds, treatments, or procedures to treat, inhibit, reduce, or prevent PH1 or other lactate dehydrogenase-associated disease or disorder in a subject or organism as are known in the art.

A dsRNA agent of the invention can be conjugated (e.g., at its 5' or 3' terminus of its sense or antisense strand) or unconjugated to another moiety (e.g. a non-nucleic acid moiety such as a peptide), an organic compound (e.g., a dye, cholesterol, or the like). Modifying dsRNA agents in this way may improve cellular uptake or enhance cellular targeting activities of the resulting dsRNA agent derivative as compared to the corresponding unconjugated dsRNA agent, are useful for tracing the dsRNA agent derivative in the cell, or improve the stability of the dsRNA agent derivative compared to the corresponding unconjugated dsRNA agent.

Methods of Introducing Nucleic Acids, Vectors, and Host Cells dsRNA agents of the invention may be directly introduced into a cell (i.e., intracellularly); or introduced extracellularly into a cavity, interstitial space, into the circulation of an organism, introduced orally, or may be introduced by bathing a cell or organism in a solution containing the nucleic acid. Vascular or extravascular circulation, the blood or lymph system, and the cerebrospinal fluid are sites where the nucleic acid may be introduced.

The dsRNA agents of the invention can be introduced using nucleic acid delivery methods known in art including injection of a solution containing the nucleic acid, bombardment by particles covered by the nucleic acid, soaking the cell or organism in a solution of the nucleic acid, or electroporation of cell membranes in the presence of the nucleic acid. Other methods known in the art for introducing nucleic acids to cells may be used, such as lipid-mediated carrier transport, chemical-mediated transport, and cationic liposome transfection such as calcium phosphate, and the like. The nucleic acid may be introduced along with other components that perform one or more of the following activities: enhance nucleic acid uptake by the cell or otherwise increase inhibition of the target lactate dehydrogenase RNA.

A cell having a target lactate dehydrogenase RNA may be from the germ line or somatic, totipotent or pluripotent, dividing or non-dividing, parenchyma or epithelium, immortalized or transformed, or the like. The cell may be a stem cell or a differentiated cell. Cell types that are differentiated include adipocytes, fibroblasts, myocytes, cardiomyocytes, endothelium, neurons, glia, blood cells, megakaryocytes, lymphocytes, macrophages, neutrophils, eosinophils, basophils, mast cells, leukocytes, granulocytes, keratinocytes, chondrocytes, osteoblasts, osteoclasts, hepatocytes, and cells of the endocrine or exocrine glands.

Depending on the particular target lactate dehydrogenase RNA sequence and the dose of dsRNA agent material delivered, this process may provide partial or complete loss of function for the lactate dehydrogenase RNA. A reduction or loss of RNA levels or expression (either lactate dehydrogenase RNA expression or encoded polypeptide expression) in at least 50%, 60%, 70%, 80%, 90%, 95% or 99% or more of targeted cells is exemplary. Inhibition of lactate dehydrogenase RNA levels or expression refers to the absence (or observable decrease) in the level of lactate dehydrogenase RNA or lactate dehydrogenase RNA-encoded protein. Specificity refers to the ability to inhibit the lactate dehydrogenase RNA without manifest effects on other genes of the cell. The consequences of inhibition can be confirmed by examination of the outward properties of the cell or organism or by biochemical techniques such as RNA solution hybridization, nuclease protection, Northern hybridization, reverse transcription, gene expression monitoring with a microarray, antibody binding, enzyme linked immunosorbent assay (ELISA), Western blotting, radioimmunoassay (RIA), other immunoassays, and fluorescence activated cell analysis (FACS). Inhibition of target lactate dehydrogenase RNA sequence(s) by the dsRNA agents of the invention also can be measured based upon the effect of administration of such dsRNA agents upon development/progression of PH1 or other lactate dehydrogenase-associated disease or disorder, either in vivo or in vitro. Treatment of any of these conditions can be assessed by art-recognized tests for PH1 and/or kidney function, e.g., determination of the percentage of kidney function and/or kidney stone formation (e.g., 20%, 30%, 40%, 50%, 60%, 70%, 80% or greater) that is being achieved relative to average healthy kidney function and/or stone formation of an appropriate control population. In certain embodiments, successful treatment results in a decline or halting of stone formation or a decline or halting of reduction in total kidney function associated with PH1 or other lactate dehydrogenase-associated disease or disorder. In some embodiments, kidney function improves with successful treatment.

For RNA-mediated inhibition in a cell line or whole organism, expression a reporter or drug resistance gene whose protein product is easily assayed can be measured. Such reporter genes include acetohydroxyacid synthase (AHAS), alkaline phosphatase (AP), beta galactosidase (LacZ), beta glucoronidase (GUS), chloramphenicol acetyltransferase (CAT), green fluorescent protein (GFP), horseradish peroxidase (HRP), luciferase (Luc), nopaline synthase (NOS), octopine synthase (OCS), and derivatives thereof. Multiple selectable markers are available that confer resistance to ampicillin, bleomycin, chloramphenicol, gentamycin, hygromycin, kanamycin, lincomycin, methotrexate, phosphinothricin, puromycin, and tetracyclin. Depending on the assay, quantitation of the amount of gene expression allows one to determine a degree of inhibition which is greater than 10%, 33%, 50%, 90%, 95% or 99% as compared to a cell not treated according to the present invention.

Lower doses of injected material and longer times after administration of RNA silencing agent may result in inhibition in a smaller fraction of cells (e.g., at least 10%, 20%, 50%, 75%, 90%, or 95% of targeted cells). Quantitation of gene expression in a cell may show similar amounts of inhibition at the level of accumulation of target lactate dehydrogenase RNA or translation of target protein. As an example, the efficiency of inhibition may be determined by assessing the amount of gene product in the cell; RNA may be detected with a hybridization probe having a nucleotide sequence outside the region used for the inhibitory dsRNA, or translated polypeptide may be detected with an antibody raised against the polypeptide sequence of that region.

The dsRNA agent may be introduced in an amount which allows delivery of at least one copy per cell. Higher doses (e.g., at least 5, 10, 100, 500 or 1000 copies per cell) of material may yield more effective inhibition; lower doses may also be useful for specific applications.

Pharmaceutical Compositions

In certain embodiments, the present invention provides for a pharmaceutical composition comprising the dsRNA agent of the present invention. The dsRNA agent sample can be suitably formulated and introduced into the environment of the cell by any means that allows for a sufficient portion of the sample to enter the cell to induce gene silencing, if it is to occur. Many formulations for dsRNA are known in the art and can be used so long as the dsRNA gains entry to the target cells so that it can act. See, e.g., U.S. published patent application Nos. 2004/0203145 A1 and 2005/0054598 A1. For example, the dsRNA agent of the instant invention can be formulated in buffer solutions such as phosphate buffered saline solutions, liposomes, micellar structures, and capsids. Formulations of dsRNA agent with cationic lipids can be used to facilitate transfection of the dsRNA agent into cells. For example, cationic lipids, such as lipofectin (U.S. Pat. No. 5,705,188), cationic glycerol derivatives, and polycationic molecules, such as polylysine (published PCT International Application WO 97/30731), can be used. Suitable lipids include Oligofectamine, Lipofectamine (Life Technologies), NC388 (Ribozyme Pharmaceuticals, Inc., Boulder, Colo.), or FuGene 6 (Roche) all of which can be used according to the manufacturer's instructions.

Such compositions typically include the nucleic acid molecule and a pharmaceutically acceptable carrier. As used herein the language "pharmaceutically acceptable carrier" includes saline, solvents, dispersion media, coatings, antibacterial and antifungal agents, isotonic and absorption delaying agents, and the like, compatible with pharmaceutical administration. Supplementary active compounds can also be incorporated into the compositions.

A pharmaceutical composition is formulated to be compatible with its intended route of administration. Examples of routes of administration include parenteral, e.g., intravenous, intradermal, subcutaneous, oral (e.g., inhalation), transdermal (topical), transmucosal, and rectal administration. Solutions or suspensions used for parenteral, intradermal, or subcutaneous application can include the following components: a sterile diluent such as water for injection, saline solution, fixed oils, polyethylene glycols, glycerine, propylene glycol or other synthetic solvents; antibacterial agents such as benzyl alcohol or methyl parabens; antioxidants such as ascorbic acid or sodium bisulfite; chelating agents such as ethylenediaminetetraacetic acid; buffers such as acetates, citrates or phosphates and agents for the adjustment of tonicity such as sodium chloride or dextrose. pH can be adjusted with acids or bases, such as hydrochloric acid or sodium hydroxide. The parenteral preparation can be enclosed in ampoules, disposable syringes or multiple dose vials made of glass or plastic.

Pharmaceutical compositions suitable for injectable use include sterile aqueous solutions (where water soluble) or dispersions and sterile powders for the extemporaneous preparation of sterile injectable solutions or dispersion. For intravenous administration, suitable carriers include physiological saline, bacteriostatic water, Cremophor EL™ (BASF, Parsippany, N.J.) or phosphate buffered saline (PBS). In all cases, the composition must be sterile and should be fluid to the extent that easy syringability exists. It should be stable under the conditions of manufacture and storage and must be preserved against the contaminating action of microorganisms such as bacteria and fungi. The carrier can be a solvent or dispersion medium containing, for example, water, ethanol, polyol (for example, glycerol, propylene glycol, and liquid polyetheylene glycol, and the like), and suitable mixtures thereof. The proper fluidity can be maintained, for example, by the use of a coating such as lecithin, by the maintenance of the required particle size in the case of dispersion and by the use of surfactants. Prevention of the action of microorganisms can be achieved by various antibacterial and antifungal agents, for example, parabens, chlorobutanol, phenol, ascorbic acid, thimerosal, and the like. In many cases, it will be preferable to include isotonic agents, for example, sugars, polyalcohols such as manitol, sorbitol, sodium chloride in the composition. Prolonged absorption of the injectable compositions can be brought about by including in the composition an agent which delays absorption, for example, aluminum monostearate and gelatin.

Sterile injectable solutions can be prepared by incorporating the active compound in the required amount in a selected solvent with one or a combination of ingredients enumerated above, as required, followed by filtered sterilization. Generally, dispersions are prepared by incorporating the active compound into a sterile vehicle, which contains a basic dispersion medium and the required other ingredients from those enumerated above. In the case of sterile powders for the preparation of sterile injectable solutions, the preferred methods of preparation are vacuum drying and freeze-drying which yields a powder of the active ingredient plus any additional desired ingredient from a previously sterile-filtered solution thereof.

Oral compositions generally include an inert diluent or an edible carrier. For the purpose of oral therapeutic administration, the active compound can be incorporated with excipients and used in the form of tablets, troches, or capsules, e.g., gelatin capsules. Oral compositions can also be prepared using a fluid carrier for use as a mouthwash. Pharmaceutically compatible binding agents, and/or adjuvant materials can be included as part of the composition. The tablets, pills, capsules, troches and the like can contain any of the following ingredients, or compounds of a similar nature: a binder such as microcrystalline cellulose, gum tragacanth or gelatin; an excipient such as starch or lactose, a disintegrating agent such as alginic acid, Primogel, or corn starch; a lubricant such as magnesium stearate or Sterotes; a glidant such as colloidal silicon dioxide; a sweetening agent such as sucrose or saccharin; or a flavoring agent such as peppermint, methyl salicylate, or orange flavoring.

For administration by inhalation, the compounds are delivered in the form of an aerosol spray from pressured container or dispenser which contains a suitable propellant, e.g., a gas such as carbon dioxide, or a nebulizer. Such methods include those described in U.S. Pat. No. 6,468,798.

Systemic administration can also be by transmucosal or transdermal means. For transmucosal or transdermal administration, penetrants appropriate to the barrier to be permeated are used in the formulation. Such penetrants are generally known in the art, and include, for example, for transmucosal administration, detergents, bile salts, and fusidic acid derivatives. Transmucosal administration can be accomplished through the use of nasal sprays or suppositories. For transdermal administration, the active compounds are formulated into ointments, salves, gels, or creams as generally known in the art.

The compounds can also be prepared in the form of suppositories (e.g., with conventional suppository bases such as cocoa butter and other glycerides) or retention enemas for rectal delivery.

The compounds can also be administered by transfection or infection using methods known in the art, including but not limited to the methods described in McCaffrey et al. (2002), Nature, 418(6893), 38-9 (hydrodynamic transfection); Xia et al. (2002), Nature Biotechnol., 20(10), 1006-10 (viral-mediated delivery); or Putnam (1996), Am. J. Health Syst. Pharm. 53(2), 151-160, erratum at Am. J. Health Syst. Pharm. 53(3), 325 (1996).

The compounds can also be administered by a method suitable for administration of nucleic acid agents, such as a DNA vaccine. These methods include gene guns, bio injectors, and skin patches as well as needle-free methods such as the micro-particle DNA vaccine technology disclosed in U.S. Pat. No. 6,194,389, and the mammalian transdermal needle-free vaccination with powder-form vaccine as disclosed in U.S. Pat. No. 6,168,587. Additionally, intranasal delivery is possible, as described in, inter alia, Hamajima et al. (1998), Clin. Immunol. Immunopathol., 88(2), 205-10. Liposomes (e.g., as described in U.S. Pat. No. 6,472,375) and microencapsulation can also be used. Biodegradable targetable microparticle delivery systems can also be used (e.g., as described in U.S. Pat. No. 6,471,996).

In one embodiment, the active compounds are prepared with carriers that will protect the compound against rapid elimination from the body, such as a controlled release formulation, including implants and microencapsulated delivery systems. Biodegradable, biocompatible polymers can be used, such as ethylene vinyl acetate, polyanhydrides, polyglycolic acid, collagen, polyorthoesters, and polylactic acid. Such formulations can be prepared using standard techniques. The materials can also be obtained commercially from Alza Corporation and Nova Pharmaceuticals, Inc. Liposomal suspensions can also be used as pharmaceutically acceptable carriers. These can be prepared according to methods known to those skilled in the art, for example, as described in U.S. Pat. No. 4,522,811.

Toxicity and therapeutic efficacy of such compounds can be determined by standard pharmaceutical procedures in cell cultures or experimental animals, e.g., for determining the $LD_{50}$ (the dose lethal to 50% of the population) and the $ED_{50}$ (the dose therapeutically effective in 50% of the population). The dose ratio between toxic and therapeutic effects is the therapeutic index and it can be expressed as the ratio $LD_{50}/ED_{50}$. Compounds which exhibit high therapeutic indices are preferred. While compounds that exhibit toxic side effects may be used, care should be taken to design a delivery system that targets such compounds to the site of affected tissue in order to minimize potential damage to uninfected cells and, thereby, reduce side effects.

The data obtained from the cell culture assays and animal studies can be used in formulating a range of dosage for use in humans. The dosage of such compounds lies preferably within a range of circulating concentrations that include the $ED_{50}$ with little or no toxicity. The dosage may vary within this range depending upon the dosage form employed and the route of administration utilized. For a compound used in the method of the invention, the therapeutically effective dose can be estimated initially from cell culture assays. A dose may be formulated in animal models to achieve a circulating plasma concentration range that includes the $IC_{50}$ (i.e., the concentration of the test compound which achieves a half-maximal inhibition of symptoms) as determined in cell culture. Such information can be used to more accurately determine useful doses in humans. Levels in plasma may be measured, for example, by high performance liquid chromatography.

As defined herein, a therapeutically effective amount of a nucleic acid molecule (i.e., an effective dosage) depends on the nucleic acid selected. For instance, single dose amounts of a dsRNA (or, e.g., a construct(s) encoding for such dsRNA) in the range of approximately 1 µg to 1000 mg may be administered; in some embodiments, 10, 30, 100, or 1000 µg, or 10, 30, 100, or 1000 ng, or 10, 30, 100, or 1000 µg, or 10, 30, 100, or 1000 mg may be administered. In some embodiments, 1-5 g of the compositions can be administered. The compositions can be administered one from one or more times per day to one or more times per week; including once every other day. The skilled artisan will appreciate that certain factors may influence the dosage and timing required to effectively treat a subject, including but not limited to the severity of the disease or disorder, previous treatments, the general health and/or age of the subject, and other diseases present. Moreover, treatment of a subject with a therapeutically effective amount of a nucleic acid (e.g., dsRNA), protein, polypeptide, or antibody can include a single treatment or, preferably, can include a series of treatments.

The nucleic acid molecules of the invention can be inserted into expression constructs, e.g., viral vectors, retroviral vectors, expression cassettes, or plasmid viral vectors, e.g., using methods known in the art, including but not limited to those described in Xia et al., (2002), supra. Expression constructs can be delivered to a subject by, for example, inhalation, orally, intravenous injection, local administration (see U.S. Pat. No. 5,328,470) or by stereotactic injection (see e.g., Chen et al. (1994), Proc. Natl. Acad. Sci. USA, 91, 3054-3057). The pharmaceutical preparation of the delivery vector can include the vector in an acceptable diluent, or can comprise a slow release matrix in which the delivery vehicle is imbedded. Alternatively, where the complete delivery vector can be produced intact from recombinant cells, e.g., retroviral vectors, the pharmaceutical preparation can include one or more cells which produce the gene delivery system.

The expression constructs may be constructs suitable for use in the appropriate expression system and include, but are not limited to retroviral vectors, linear expression cassettes, plasmids and viral or virally-derived vectors, as known in the art. Such expression constructs may include one or more inducible promoters, RNA Pol III promoter systems such as U6 snRNA promoters or H1 RNA polymerase III promoters, or other promoters known in the art. The constructs can include one or both strands of the siRNA. Expression constructs expressing both strands can also include loop structures linking both strands, or each strand can be separately transcribed from separate promoters within the same construct. Each strand can also be transcribed from a separate expression construct, e.g., Tuschl (2002, *Nature Biotechnol* 20: 500-505).

It can be appreciated that the method of introducing dsRNA agents into the environment of the cell will depend on the type of cell and the make up of its environment. For example, when the cells are found within a liquid, one preferable formulation is with a lipid formulation such as in lipofectamine and the dsRNA agents can be added directly to the liquid environment of the cells. Lipid formulations can also be administered to animals such as by intravenous, intramuscular, or intraperitoneal injection, or orally or by inhalation or other methods as are known in the art. When the formulation is suitable for administration into animals such as mammals and more specifically humans, the formulation is also pharmaceutically acceptable. Pharmaceutically acceptable formulations for administering oligonucleotides are known and can be used. In some instances, it may be preferable to formulate dsRNA agents in a buffer or saline solution and directly inject the formulated dsRNA agents into cells, as in studies with oocytes. The direct injection of dsRNA agent duplexes may also be done. For suitable methods of introducing dsRNA (e.g., DsiRNA agents), see U.S. published patent application No. 2004/0203145 A1.

Suitable amounts of a dsRNA agent must be introduced and these amounts can be empirically determined using standard methods. Typically, effective concentrations of individual dsRNA agent species in the environment of a cell will be 50 nanomolar or less, 10 nanomolar or less, or compositions in which concentrations of 1 nanomolar or less can be used. In another embodiment, methods utilizing a concentration of 200 picomolar or less, 100 picomolar or less, 50 picomolar or less, 20 picomolar or less, and even a concentration of 10 picomolar or less, 5 picomolar or less, 2 picomolar or less or 1 picomolar or less can be used in many circumstances.

The method can be carried out by addition of the dsRNA agent compositions to an extracellular matrix in which cells can live provided that the dsRNA agent composition is formulated so that a sufficient amount of the dsRNA agent can enter the cell to exert its effect. For example, the method is amenable for use with cells present in a liquid such as a liquid culture or cell growth media, in tissue explants, or in whole organisms, including animals, such as mammals and especially humans.

The level or activity of a lactate dehydrogenase RNA can be determined by a suitable method now known in the art or that is later developed. It can be appreciated that the method used to measure a target RNA and/or the expression of a target RNA can depend upon the nature of the target RNA. For example, where the target lactate dehydrogenase RNA sequence encodes a protein, the term "expression" can refer to a protein or the lactate dehydrogenase RNA/transcript derived from the lactate dehydrogenase gene (either genomic or of exogenous origin). In such instances the expression of the target lactate dehydrogenase RNA can be determined by measuring the amount of lactate dehydrogenase RNA/transcript directly or by measuring the amount of lactate dehydrogenase protein. Protein can be measured in protein assays such as by staining or immunoblotting or, if the protein catalyzes a reaction that can be measured, by measuring reaction rates. All such methods are known in the art and can be used. Where target lactate dehydrogenase RNA levels are to be measured, art-recognized methods for detecting RNA levels can be used (e.g., RT-PCR, Northern Blotting, etc.). In targeting lactate dehydrogenase RNAs with the dsRNA agents of the instant invention, it is also anticipated that measurement of the efficacy of a dsRNA agent in reducing levels of lactate dehydrogenase RNA or protein in a subject, tissue, in cells, either in vitro or in vivo, or in cell extracts can also be used to determine the extent of reduction of PH1, oxalate accumulation or other lactate dehydrogenase-associated disease or disorder phenotypes (e.g., kidney function, kidney stones, etc.). The above measurements can be made on cells, cell extracts, tissues, tissue extracts or other suitable source material.

The determination of whether the expression of a lactate dehydrogenase RNA has been reduced can be by a suitable method that can reliably detect changes in RNA levels. Typically, the determination is made by introducing into the environment of a cell undigested dsRNA such that at least a portion of that dsRNA agent enters the cytoplasm, and then measuring the level of the target RNA. The same measurement is made on identical untreated cells and the results obtained from each measurement are compared.

The dsRNA agent can be formulated as a pharmaceutical composition which comprises a pharmacologically effective amount of a dsRNA agent and pharmaceutically acceptable carrier. A pharmacologically or therapeutically effective amount refers to that amount of a dsRNA agent effective to produce the intended pharmacological, therapeutic or preventive result. The phrases "pharmacologically effective amount" and "therapeutically effective amount" or simply "effective amount" refer to that amount of an RNA effective to produce the intended pharmacological, therapeutic or preventive result. For example, if a given clinical treatment is considered effective when there is at least a 20% reduction in a measurable parameter associated with a disease or disorder, a therapeutically effective amount of a drug for the treatment of that disease or disorder is the amount necessary to effect at least a 20% reduction in that parameter.

Suitably formulated pharmaceutical compositions of this invention can be administered by means known in the art such as by parenteral routes, including intravenous, intramuscular, intraperitoneal, subcutaneous, transdermal, airway (aerosol), rectal, vaginal and topical (including buccal and sublingual) administration. In some embodiments, the pharmaceutical compositions are administered by intravenous or intraparenteral infusion or injection.

In general, a suitable dosage unit of dsRNA will be in the range of 0.001 to 0.25 milligrams per kilogram body weight of the recipient per day, or in the range of 0.01 to 20 micrograms per kilogram body weight per day, or in the range of 0.001 to 5 micrograms per kilogram of body weight per day, or in the range of 1 to 500 nanograms per kilogram of body weight per day, or in the range of 0.01 to 10 micrograms per kilogram body weight per day, or in the range of 0.10 to 5 micrograms per kilogram body weight per day, or in the range of 0.1 to 2.5 micrograms per kilogram body weight per day. A pharmaceutical composition comprising the dsRNA can be administered once daily. However, the therapeutic agent may also be dosed in dosage units containing two, three, four, five, six or more sub-doses administered at appropriate intervals throughout the day. In that case, the dsRNA contained in each sub-dose must be correspondingly smaller in order to achieve the total daily dosage unit. The dosage unit can also be compounded for a single dose over several days, e.g., using a conventional sustained release formulation which provides sustained and consistent release of the dsRNA over a several day period. Sustained release formulations are well known in the art. In this embodiment, the dosage unit contains a corresponding multiple of the daily dose. Regardless of the formulation, the pharmaceutical composition must contain dsRNA in a quantity sufficient to inhibit expression of the target gene in the animal or human being treated. The composition can be compounded in such a way that the sum of the multiple units of dsRNA together contain a sufficient dose.

Data can be obtained from cell culture assays and animal studies to formulate a suitable dosage range for humans. The dosage of compositions of the invention lies within a range of circulating concentrations that include the $ED_{50}$ (as determined by known methods) with little or no toxicity. The dosage may vary within this range depending upon the dosage form employed and the route of administration utilized. For a compound used in the method of the invention, the therapeutically effective dose can be estimated initially from cell culture assays. A dose may be formulated in animal models to achieve a circulating plasma concentration range of the compound that includes the $IC_{50}$ (i.e., the concentration of the test compound which achieves a half-maximal inhibition of symptoms) as determined in cell culture. Such information can be used to more accurately determine useful doses in humans. Levels of dsRNA in plasma may be measured by standard methods, for example, by high performance liquid chromatography.

The pharmaceutical compositions can be included in a kit, container, pack, or dispenser together with instructions for administration.

Formulations can give trophism, and there are certain benefits to that. Specificity of LDHA, LDHB, LDHC are advantageous. [[Back off of statements re tissue specificity—what if delivery to muscle does not impact negatively]].

Methods of Treatment

The present invention provides for both prophylactic and therapeutic methods of treating a subject at risk of (or susceptible to) a disease or disorder caused, in whole or in part, by lactate dehydrogenase (e.g., misregulation and/or elevation of lactate dehydrogenase transcript and/or lactate dehydrogenase protein levels), or treatable via selective targeting of lactate dehydrogenase.

In certain aspects, the invention provides a method for preventing in a subject, a disease or disorder as described herein (including, e.g., prevention of PH1 within a subject via inhibition of lactate dehydrogenase expression), by administering to the subject a therapeutic agent (e.g., a dsRNA agent or vector or transgene encoding same). Subjects at risk for the disease can be identified by, for example, one or a combination of diagnostic or prognostic assays known in the art (e.g., identification of reduced functionality of AGT, or other altered functioning of the oxalate-producing pathway, in a subject). Administration of a prophylactic agent can occur prior to the detection of, e.g., PH1 in a subject, or the manifestation of symptoms characteristic of the disease or disorder, such that the disease or disorder is prevented or, alternatively, delayed in its progression.

Another aspect of the invention pertains to methods of treating subjects therapeutically, i.e., altering the onset of symptoms of the disease or disorder. These methods can be performed in vitro (e.g., by culturing the cell with the dsRNA agent) or, alternatively, in vivo (e.g., by administering the dsRNA agent to a subject).

With regard to both prophylactic and therapeutic methods of treatment, such treatments may be specifically tailored or modified, based on knowledge obtained from the field of pharmacogenomics. "Pharmacogenomics", as used herein, refers to the application of genomics technologies such as gene sequencing, statistical genetics, and gene expression analysis to drugs in clinical development and on the market. More specifically, the term refers the study of how a patient's genes determine his or her response to a drug (e.g., a patient's "drug response phenotype", or "drug response genotype"). Thus, another aspect of the invention provides methods for tailoring an individual's prophylactic or therapeutic treatment with either the target lactate dehydrogenase RNA molecules of the present invention or target lactate dehydrogenase RNA modulators according to that individual's drug response genotype. Pharmacogenomics allows a clinician or physician to target prophylactic or therapeutic treatments to patients who will most benefit from the treatment and to avoid treatment of patients who will experience toxic drug-related side effects.

The practice of the present invention employs, unless otherwise indicated, conventional techniques of chemistry, molecular biology, microbiology, recombinant DNA, genetics, immunology, cell biology, cell culture and transgenic biology, which are within the skill of the art. See, e.g., Maniatis et al., 1982, Molecular Cloning (Cold Spring Harbor Laboratory Press, Cold Spring Harbor, N.Y.); Sambrook et al., 1989, Molecular Cloning, 2nd Ed. (Cold Spring Harbor Laboratory Press, Cold Spring Harbor, N.Y.); Sambrook and Russell, 2001, Molecular Cloning, 3rd Ed. (Cold Spring Harbor Laboratory Press, Cold Spring Harbor, N.Y.); Ausubel et al., 1992), Current Protocols in Molecular Biology (John Wiley & Sons, including periodic updates); Glover, 1985, DNA Cloning (IRL Press, Oxford); Anand, 1992; Guthrie and Fink, 1991; Harlow and Lane, 1988, Antibodies, (Cold Spring Harbor Laboratory Press, Cold Spring Harbor, N.Y.); Jakoby and Pastan, 1979; Nucleic Acid Hybridization (B. D. Hames & S. J. Higgins eds. 1984); Transcription And Translation (B. D. Hames & S. J. Higgins eds. 1984); Culture Of Animal Cells (R. I. Freshney, Alan R. Liss, Inc., 1987); Immobilized Cells And Enzymes (IRL Press, 1986); B. Perbal, A Practical Guide To Molecular Cloning (1984); the treatise, Methods In Enzymology (Academic Press, Inc., N.Y.); Gene Transfer Vectors For Mammalian Cells (J. H. Miller and M. P. Calos eds., 1987, Cold Spring Harbor Laboratory); Methods In Enzymology, Vols. 154 and 155 (Wu et al. eds.), Immunochemical Methods In Cell And Molecular Biology (Mayer and Walker, eds., Academic Press, London, 1987); Handbook Of Experimental Immunology, Volumes I-IV (D. M. Weir and C. C. Blackwell, eds., 1986); Riott, Essential Immunology, 6th Edition, Blackwell Scientific Publications, Oxford, 1988; Hogan et al., Manipulating the Mouse Embryo, (Cold Spring Harbor Laboratory Press, Cold Spring Harbor, N.Y., 1986); Westerfield, M., The zebrafish book. A guide for the laboratory use of zebrafish (*Danio rerio*), (4th Ed., Univ. of Oregon Press, Eugene, 2000).

Unless otherwise defined, all technical and scientific terms used herein have the same meaning as commonly understood by one of ordinary skill in the art to which this invention belongs. Although methods and materials similar or equivalent to those described herein can be used in the practice or testing of the present invention, suitable methods and materials are described below. All publications, patent applications, patents, and other references mentioned herein are incorporated by reference in their entirety. In case of conflict, the present specification, including definitions, will control. In addition, the materials, methods, and examples are illustrative only and not intended to be limiting.

EXAMPLES

The present invention is described by reference to the following Examples, which are offered by way of illustration and are not intended to limit the invention in any manner. Standard techniques well known in the art or the techniques specifically described below were utilized.

Example 1: Preparation of Double-Stranded RNA Oligonucleotides

Oligonucleotide Synthesis and Purification

DsiRNA molecules can be designed to interact with various sites in the RNA message, for example, target sequences within the RNA sequences described herein. In presently exemplified agents, 48 DsiRNAs predicted on the basis of homology to uniquely target human lactate dehydrogenase (LDHA) sequences, 48 DsiRNAs predicted on the basis of homology to uniquely target mouse lactate dehydrogenase sequences, and an additional 24 DsiRNAs predicted to target both human and mouse lactate dehydrogenase sequences were selected for evaluation. The sequences of one strand of the DsiRNA molecules were complementary to target lactate dehydrogenase site sequences. The DsiRNA molecules were chemically synthesized using methods described herein. Generally, DsiRNA constructs were synthesized using solid phase oligonucleotide synthesis methods as described for 19-23mer siRNAs (see for example Usman et al., U.S. Pat. Nos. 5,804,683; 5,831,071; 5,998,203; 6,117,657; 6,353,098; 6,362,323; 6,437,117; 6,469,158; Scaringe et al., U.S. Pat. Nos. 6,111,086; 6,008,400; 6,111,086).

Individual RNA strands were synthesized and HPLC purified according to standard methods (Integrated DNA Technologies, Coralville, Iowa). For example, RNA oligonucleotides were synthesized using solid phase phosphoramidite chemistry, deprotected and desalted on NAP-5 columns (Amersham Pharmacia Biotech, Piscataway, N.J.) using standard techniques (Damha and Olgivie, 1993, *Methods Mol Biol* 20: 81-114; Wincott et al., 1995, *Nucleic Acids Res* 23: 2677-84). The oligomers were purified using ion-exchange high performance liquid chromatography (IE-HPLC) on an Amersham Source 15Q column (1.0 cm×25 cm; Amersham Pharmacia Biotech, Piscataway, N.J.) using a 15 min step-linear gradient. The gradient varied from 90:10 Buffers A:B to 52:48 Buffers A:B, where Buffer A was 100 mM Tris pH 8.5 and Buffer B was 100 mM Tris pH 8.5, 1 M NaCl. Samples were monitored at 260 nm and peaks corresponding to the full-length oligonucleotide species were collected, pooled, desalted on NAP-5 columns, and lyophilized.

The purity of each oligomer was determined by capillary electrophoresis (CE) on a Beckman PACE 5000 (Beckman Coulter, Inc., Fullerton, Calif.). The CE capillaries had a 100 m inner diameter and contained ssDNA 100R Gel (Beckman-Coulter). Typically, about 0.6 nmole of oligonucleotide was injected into a capillary, run in an electric field of 444 V/cm and detected by UV absorbance at 260 nm. Denaturing Tris-Borate-7 M-urea running buffer was purchased from Beckman-Coulter. Oligoribonucleotides were obtained that were at least 90% pure as assessed by CE for use in experiments described below. Compound identity was verified by matrix-assisted laser desorption ionization time-of-flight (MALDI-TOF) mass spectroscopy on a Voyager DE™ Biospectometry Work Station (Applied Biosystems, Foster City, Calif.) following the manufacturer's recommended protocol. Relative molecular masses of all oligomers were obtained, often within 0.2% of expected molecular mass.

Preparation of Duplexes

Single-stranded RNA (ssRNA) oligomers were resuspended, e.g., at 100 µM concentration in duplex buffer consisting of 100 mM potassium acetate, 30 mM HEPES, pH 7.5. Complementary sense and antisense strands were mixed in equal molar amounts to yield a final solution of, e.g., 50 µM duplex. Samples were heated to 100° C. for 5' in RNA buffer (IDT) and allowed to cool to room temperature before use. Double-stranded RNA (dsRNA) oligomers were stored at −20° C. Single-stranded RNA oligomers were stored lyophilized or in nuclease-free water at −80° C.

Nomenclature

For consistency, the following nomenclature has been employed in the instant specification. Names given to duplexes indicate the length of the oligomers and the presence or absence of overhangs. A "25/27" is an asymmetric duplex having a 25 base sense strand and a 27 base antisense strand with a 2-base 3'-overhang. A "27/25" is an asymmetric duplex having a 27 base sense strand and a 25 base antisense strand.

Cell Culture and RNA Transfection

HeLa cells were obtained and maintained in DMEM (HyClone) supplemented with 10% fetal bovine serum (HyClone) at 37° C. under 5% $CO_2$. For RNA transfections, cells were transfected with DsiRNAs at a final concentration of 1 nM, 0.1 nM or 0.03 nM using Lipofectamine™ RNAiMAX (Invitrogen) and following manufacturer's instructions. Briefly, for 0.1 nM transfections, e.g., of Example 3 below, an aliquot of stock solution of each DsiRNA was mixed with Opti-MEM I (Invitrogen) and Lipofectamine™ RNAiMAX to reach a volume of 150 µL (with 0.3 nM DsiRNA). The resulting 150 µL mix was incubated for 20 min at RT to allow DsiRNA:Lipofectamine™ RNAiMAX complexes to form. Meanwhile, target cells were trypsinized and resuspended in medium. At the end of the 20 min of complexation, 50 µL of the DsiRNA:RNAiMAX mixture was added per well into triplicate wells of 96 well plates. Finally, 100 µL of the cell suspension was added to each well (final volume 150 µL) and plates were placed into the incubator for 24 hours.

Assessment of LDHA Inhibition

Lactate Dehydrogenase target gene knockdown was determined by qRT-PCR, with values normalized to HPRT and SFRS9 housekeeping genes, and to transfections with control DsiRNAs and/or mock transfection controls.

RNA Isolation and Analysis

Media was aspirated, and total RNA was extracted using the SV96 kit (Promega). Total RNA was reverse-transcribed using SuperscriptII, Oligo dT, and random hexamers following manufacturer's instructions. Typically, the resulting cDNA was analyzed by qPCR using primers and probes specific for both the lactate dehydrogenase gene and for the human genes HPRT-1 and SFRS9. An ABI 7700 was used for the amplification reactions. Each sample was tested in triplicate. Relative LDHA RNA levels were normalized to HPRT1 and SFRS9 RNA levels and compared with RNA levels obtained in transfection control samples.

Example 2: DsiRNA Inhibition of LDHA

DsiRNA molecules targeting LDHA were designed and synthesized as described above and tested in human HeLa cells (alternatively, HepG2 or other human cells could have been used) and/or mouse B16-F10 cells for inhibitory efficacy. For transfection, annealed DsiRNAs were mixed with the transfection reagent (Lipofectamine™ RNAiMAX, Invitrogen) and incubated for 20 minutes at room temperature. The HeLa (human) or B16-F10 (mouse) cells (alternatively, mouse Hepa 1-6 or other mouse cells could have been used) were trypsinized, resuspended in media, and added to wells (100 uL per well) to give a final DsiRNA concentration of 1 nM in a volume of 150 µl. Each DsiRNA transfection mixture was added to 3 wells for triplicate DsiRNA treatments. Cells were incubated at 37° C. for 24 hours in the continued presence of the DsiRNA transfection mixture. At 24 hours, RNA was prepared from each well of treated cells. The supernatants with the transfection mixtures were first removed and discarded, then the cells were lysed and RNA was prepared from each well. Target LDHA RNA levels following treatment were evaluated by qRT-PCR for the LDHA target gene, with values normalized to those obtained for controls. Triplicate data was averaged and the % error was determined for each treatment. Normalized data were both tabulated and graphed, and the reduction of target mRNA by active DsiRNAs in comparison to controls was determined (see Table 13 below and FIGS. 3A to 3J).

TABLE 13

LDHA Inhibitory Efficacy of DsiRNAs Assayed at 1 nM in Human HeLa and Mouse B16-F10 Cells

| | | | Human - HeLa Normalized HPRT/SFRS9; vs NC1, NC5, NC7 | | Mouse - B16-F10 Normalized HPRT/Rpl23; vs NC1, NC5, NC7 | |
|---|---|---|---|---|---|---|
| Duplex Name | Mm Location | Rhesus Location | Hs 262-396 (FAM) Assay % Remaining | Hs 1304-1419 (HEX) Assay % Remaining | Mm 384-510 (FAM) Assay % Remaining | Mm 1402-1504 (HEX) Assay % Remaining |
| LDHA-355 | | 440 | 2.7 ± 17.5 | 2.8 ± 14.8 | | |
| LDHA-356 | | 441 | 2.6 ± 8.5 | 2.6 ± 9.6 | | |
| LDHA-397 | | 482 | 8.5 ± 12.5 | 8.8 ± 11.1 | | |
| LDHA-398 | | 483 | 2.8 ± 11.5 | 3.1 ± 12.4 | | |
| LDHA-739 | | 824 | 8.7 ± 19.5 | 9.0 ± 17.6 | | |
| LDHA-740 | | 825 | 3.9 ± 11.6 | 3.7 ± 13.2 | | |
| LDHA-891 | | 976 | 3.9 ± 7.0 | 3.8 ± 7.5 | | |
| LDHA-892 | | 977 | 2.5 ± 5.3 | 2.4 ± 3.8 | | |
| LDHA-907 | | 992 | 4.4 ± 8.1 | 4.1 ± 8.5 | | |
| LDHA-952 | | 1037 | 2.9 ± 3.4 | 2.8 ± 6.0 | | |
| LDHA-1286 | | 1371 | 3.7 ± 11.1 | 3.6 ± 2.7 | | |
| LDHA-1287 | | 1372 | 2.0 ± 2.2 | 1.9 ± 4.1 | | |
| LDHA-1292 | | 1377 | 4.3 ± 2.0 | 4.3 ± 5.9 | | |
| LDHA-1293 | | 1378 | 2.2 ± 5.6 | 1.7 ± 1.6 | | |
| LDHA-1294 | | 1379 | 5.2 ± 4.3 | 5.2 ± 3.1 | | |
| LDHA-1359 | | 1444 | 4.5 ± 2.4 | 3.5 ± 3.2 | | |
| LDHA-1360 | | 1445 | 3.8 ± 9.4 | 3.2 ± 10.4 | | |
| LDHA-1361 | | 1446 | 3.0 ± 8.1 | 2.4 ± 8.7 | | |
| LDHA-1362 | | 1447 | 6.1 ± 5.0 | 5.1 ± 5.0 | | |
| LDHA-1363 | | 1448 | 2.5 ± 2.5 | 2.0 ± 4.4 | | |
| LDHA-1365 | | 1450 | 3.3 ± 1.2 | 2.7 ± 1.8 | | |
| LDHA-1366 | | 1451 | 3.4 ± 3.5 | 2.8 ± 2.6 | | |
| LDHA-1367 | | 1452 | 5.8 ± 1.5 | 5.3 ± 1.7 | | |
| LDHA-1368 | | 1453 | 4.5 ± 6.8 | 3.5 ± 8.7 | | |
| LDHA-1370 | | 1455 | 7.3 ± 7.0 | 6.3 ± 8.7 | | |
| LDHA-1371 | | 1456 | 2.5 ± 4.2 | 1.7 ± 7.4 | | |
| LDHA-1372 | | 1457 | 2.6 ± 6.6 | 1.9 ± 9.1 | | |
| LDHA-1393 | | 1478 | 9.1 ± 2.5 | 2.0 ± 5.9 | | |
| LDHA-1427 | | 1512 | 8.7 ± 3.1 | 3.6 ± 7.7 | | |
| LDHA-1428 | | 1513 | 8.5 ± 3.2 | 4.0 ± 12.3 | | |
| LDHA-1512 | | 1597 | 7.8 ± 2.0 | 4.4 ± 3.6 | | |
| LDHA-1513 | | 1598 | 9.4 ± 4.4 | 5.7 ± 4.1 | | |
| LDHA-1514 | | 1599 | 7.0 ± 1.7 | 3.7 ± 1.7 | | |
| LDHA-1516 | | 1601 | 6.7 ± 4.3 | 3.7 ± 5.3 | | |
| LDHA-1684 | | 1760 | 3.9 ± 10.4 | 1.7 ± 14.2 | | |
| LDHA-1688 | | 1764 | 4.7 ± 1.9 | 2.6 ± 3.6 | | |
| LDHA-1736 | | 1814 | 11.4 ± 0.6 | 8.3 ± 1.2 | | |
| LDHA-1750 | | 1832 | 3.9 ± 2.5 | 2.1 ± 3.6 | | |
| LDHA-1753 | | 1835 | 6.5 ± 1.4 | 3.2 ± 3.9 | | |
| LDHA-1754 | | 1836 | 8.0 ± 3.9 | 4.3 ± 4.8 | | |
| LDHA-1805 | | 1887 | 6.3 ± 6.9 | 3.3 ± 4.2 | | |
| LDHA-1806 | | 1888 | 6.4 ± 4.2 | 3.6 ± 4.9 | | |
| LDHA-1807 | | 1889 | 9.5 ± 2.4 | 7.6 ± 2.3 | | |
| LDHA-1808 | | 1890 | 5.7 ± 2.9 | 3.0 ± 3.4 | | |
| LDHA-1811 | | 1893 | 6.4 ± 2.8 | 2.9 ± 3.8 | | |
| LDHA-1812 | | 1894 | 5.9 ± 1.9 | 3.1 ± 1.9 | | |
| LDHA-1815 | | 1897 | 7.3 ± 3.4 | 4.0 ± 4.2 | | |
| LDHA-1816 | | 1898 | 12.2 ± 5.4 | 8.5 ± 6.7 | | |
| LDHA-360 | 419 | 445 | 7.2 ± 4.2 | 7.4 ± 3.3 | 11.2 ± 4.3 | 8.8 ± 8.0 |
| LDHA-361 | 420 | 446 | 3.5 ± 12.0 | 3.7 ± 14.2 | 6.3 ± 9.0 | 4.5 ± 10.9 |
| LDHA-362 | 421 | 447 | 8.4 ± 9.8 | 10.0 ± 9.2 | 11.6 ± 16.0 | 8.5 ± 14.0 |
| LDHA-363 | 422 | 448 | 20.5 ± 11.3 | 23.3 ± 10.4 | 26.0 ± 7.4 | 19.4 ± 11.5 |
| LDHA-364 | 423 | 449 | 7.6 ± 17.3 | 7.7 ± 15.5 | 14.1 ± 25.3 | 9.9 ± 19.4 |
| LDHA-365 | 424 | 450 | 10.4 ± 13.0 | 11.0 ± 10.5 | 13.1 ± 18.0 | 8.5 ± 14.3 |
| LDHA-366 | 425 | 451 | 15.0 ± 2.2 | 22.1 ± 2.5 | 12.6 ± 6.8 | 11.8 ± 2.9 |
| LDHA-367 | 426 | 452 | 7.8 ± 7.6 | 9.1 ± 8.6 | 9.7 ± 5.5 | 9.4 ± 4.6 |
| LDHA-369 | 428 | 454 | 23.7 ± 4.3 | 24.5 ± 3.0 | 12.7 ± 6.1 | 11.3 ± 5.1 |
| LDHA-370 | 429 | 455 | 5.9 ± 2.5 | 5.8 ± 2.2 | 6.1 ± 5.1 | 5.0 ± 9.5 |
| LDHA-399 | 458 | 484 | 3.0 ± 4.9 | 3.3 ± 11.1 | 7.3 ± 7.8 | 7.4 ± 28.4 |

TABLE 13-continued

LDHA Inhibitory Efficacy of DsiRNAs Assayed at 1 nM in Human HeLa and Mouse B16-F10 Cells

| Duplex Name | Mm Location | Rhesus Location | Human - HeLa Normalized HPRT/SFRS9; vs NC1, NC5, NC7 | | Mouse - B16-F10 Normalized HPRT/Rpl23; vs NC1, NC5, NC7 | |
|---|---|---|---|---|---|---|
| | | | Hs 262-396 (FAM) Assay % Remaining | Hs 1304-1419 (HEX) Assay % Remaining | Mm 384-510 (FAM) Assay % Remaining | Mm 1402-1504 (HEX) Assay % Remaining |
| LDHA-400 | 459 | 485 | 7.7 ± 6.2 | 8.4 ± 6.2 | 13.9 ± 1.2 | 10.2 ± 4.6 |
| LDHA-401 | 460 | 486 | 4.1 ± 6.1 | 4.1 ± 5.2 | 8.5 ± 1.8 | 5.5 ± 1.9 |
| LDHA-402 | 461 | 487 | 2.6 ± 5.7 | 3.0 ± 4.1 | 4.3 ± 5.8 | 3.0 ± 7.0 |
| LDHA-403 | 462 | 488 | 7.2 ± 3.4 | 7.2 ± 2.0 | 8.7 ± 4.4 | 7.3 ± 4.0 |
| LDHA-404 | 463 | 489 | 15.7 ± 4.1 | 14.7 ± 5.9 | 14.0 ± 7.7 | 10.8 ± 5.7 |
| LDHA-714 | 773 | 799 | 7.9 ± 11.0 | 8.4 ± 11.3 | 10.8 ± 3.0 | 9.2 ± 8.8 |
| LDHA-717 | 776 | 802 | 6.2 ± 1.4 | 7.4 ± 1.0 | 9.8 ± 7.7 | 8.7 ± 1.1 |
| LDHA-718 | 777 | 803 | 1.8 ± 7.8 | 2.0 ± 5.1 | 2.6 ± 6.8 | 3.7 ± 6.0 |
| LDHA-719 | 778 | 804 | 2.4 ± 1.9 | 2.7 ± 3.6 | 3.4 ± 3.0 | 3.3 ± 3.2 |
| LDHA-720 | 779 | 805 | 3.6 ± 5.5 | 3.6 ± 3.0 | 6.0 ± 3.2 | 5.1 ± 4.6 |
| LDHA-722 | 781 | 807 | 9.6 ± 2.2 | 10.7 ± 1.5 | 29.3 ± 36.2 | 13.8 ± 10.4 |
| LDHA-723 | 782 | 808 | 3.1 ± 5.7 | 3.1 ± 4.5 | 2.1 ± 7.8 | 2.6 ± 6.9 |
| LDHA-724 | 783 | 809 | 7.1 ± 6.4 | 7.4 ± 10.1 | 8.1 ± 7.9 | 7.1 ± 9.6 |
| LDHA-m367 | | | | | 6.7 ± 9.9 | 6.4 ± 11.1 |
| LDHA-m368 | | | | | 3.7 ± 15.8 | 3.4 ± 11.2 |
| LDHA-m372 | | | | | 6.0 ± 23.0 | 5.3 ± 14.6 |
| LDHA-m376 | | | | | 4.8 ± 1.9 | 4.5 ± 0.1 |
| LDHA-m456 | | | | | 38.3 ± 10.4 | 29.6 ± 10.4 |
| LDHA-m501 | | | | | 3.3 ± 5.3 | 3.9 ± 12.5 |
| LDHA-m506 | | | | | 17.3 ± 10.4 | 15.1 ± 11.5 |
| LDHA-m507 | | | | | 17.4 ± 5.1 | 14.4 ± 5.5 |
| LDHA-m584 | | | | | 5.9 ± 11.4 | 6.2 ± 6.0 |
| LDHA-m689 | | | | | 2.3 ± 5.0 | 3.0 ± 4.1 |
| LDHA-m694 | | | | | 2.1 ± 2.0 | 2.7 ± 3.0 |
| LDHA-m695 | | | | | 6.9 ± 1.6 | 6.0 ± 2.5 |
| LDHA-m823 | | | | | 3.6 ± 4.4 | 4.5 ± 3.1 |
| LDHA-m1071 | | | | | 4.5 ± 4.6 | 3.6 ± 4.0 |
| LDHA-m1133 | | | | | 2.8 ± 6.3 | 3.0 ± 5.5 |
| LDHA-m1183 | | | | | 6.5 ± 8.0 | 5.8 ± 7.6 |
| LDHA-m1245 | | | | | 4.9 ± 8.0 | 4.7 ± 3.0 |
| LDHA-m1250 | | | | | 5.8 ± 4.2 | 5.5 ± 4.6 |
| LDHA-m1257 | | | | | 1.7 ± 7.1 | 6.6 ± 4.0 |
| LDHA-m1687 | | | | | 29.7 ± 9.2 | 24.6 ± 10.5 |
| LDHA-m1688 | | | | | 5.6 ± 4.0 | 4.7 ± 5.2 |
| LDHA-m1690 | | | | | 12.9 ± 1.4 | 8.7 ± 1.7 |
| LDHA-m1691 | | | | | 4.2 ± 6.7 | 3.6 ± 4.0 |
| LDHA-m1692 | | | | | 10.8 ± 4.8 | 9.7 ± 6.4 |
| LDHA-m1694 | | | | | 37.2 ± 3.3 | 33.4 ± 2.5 |
| LDHA-m1695 | | | | | 9.8 ± 16.0 | 7.3 ± 16.4 |
| LDHA-m1697 | | | | | 3.6 ± 11.1 | 3.3 ± 12.3 |
| LDHA-m1698 | | | | | 6.6 ± 16.9 | 5.4 ± 18.8 |
| LDHA-m1699 | | | | | 12.3 ± 5.9 | 8.5 ± 4.8 |
| LDHA-m1700 | | | | | 3.1 ± 17.6 | 2.4 ± 14.4 |
| LDHA-m1701 | | | | | 2.1 ± 6.8 | 1.9 ± 5.6 |
| LDHA-m1702 | | | | | 4.2 ± 6.2 | 3.3 ± 3.4 |
| LDHA-m1703 | | | | | 5.2 ± 4.4 | 4.5 ± 3.3 |
| LDHA-m1704 | | | | | 6.7 ± 6.2 | 5.4 ± 5.3 |
| LDHA-m1705 | | | | | 11.5 ± 12.8 | 9.3 ± 14.7 |
| LDHA-m1706 | | | | | 13.6 ± 3.5 | 10.7 ± 2.9 |
| LDHA-m1707 | | | | | 2.8 ± 6.9 | 2.3 ± 4.8 |
| LDHA-m1708 | | | | | 3.1 ± 5.0 | 2.5 ± 3.2 |
| LDHA-m1709 | | | | | 2.2 ± 2.1 | 1.8 ± 3.2 |
| LDHA-m1710 | | | | | 4.1 ± 10.0 | 3.3 ± 9.9 |
| LDHA-m1739 | | | | | 2.9 ± 11.2 | 2.5 ± 6.3 |
| LDHA-m1743 | | | | | 3.8 ± 7.9 | 3.2 ± 7.6 |
| LDHA-m1744 | | | | | 2.2 ± 6.5 | 2.1 ± 4.0 |
| LDHA-m1746 | | | | | 2.5 ± 1.8 | 2.2 ± 3.1 |
| LDHA-m1751 | | | | | 2.5 ± 1.4 | 1.9 ± 3.0 |
| LDHA-m1752 | | | | | 4.3 ± 6.0 | 3.0 ± 4.9 |
| LDHA-m1755 | | | | | 2.9 ± 3.4 | 2.4 ± 3.4 |
| LDHA-m1756 | | | | | 3.0 ± 4.6 | 2.6 ± 7.0 |

Figure 4A:
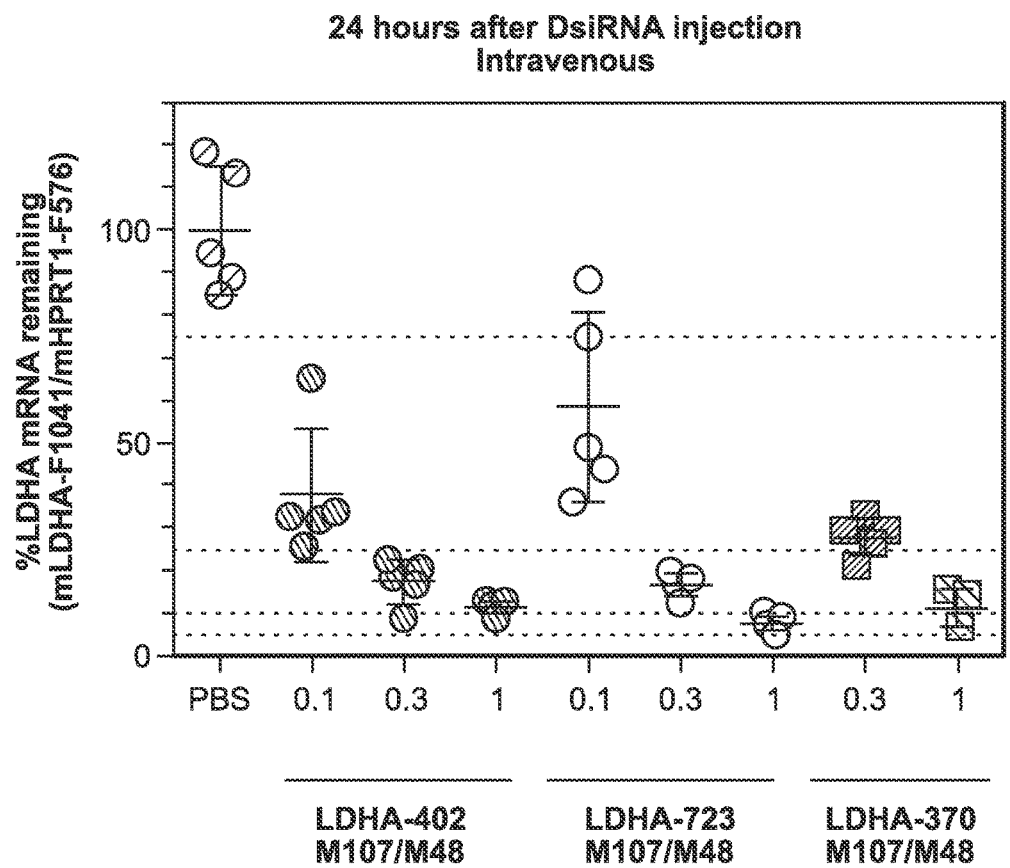
FIGS. 4A to 4C demonstrate that LDHA-targeting DsiRNAs, as well as PRODH2- and HAO1-targeting DsiRNAs potently inhibited mRNA and protein expression in mouse liver, in target-specific fashion. The histogram at the left of FIG. 4A shows that DsiRNAs LDHA-402, LDHA-723 and LDHA-370 (each of which is human-mouse cross-reactive) robustly knocked down LDHA mRNA levels at 24 hours post-DsiRNA injection. The right-hand panels of FIG. 4A show dramatically reduced levels of LDHA protein in mice administered LDHA-402 DsiRNA, even at 14 days post-i.v. injection at 1 mg/kg.
Figure 4A:
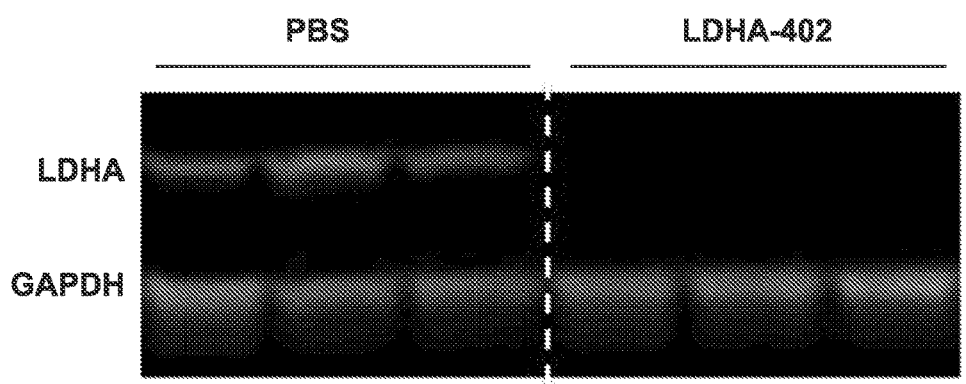
Figure 4B:
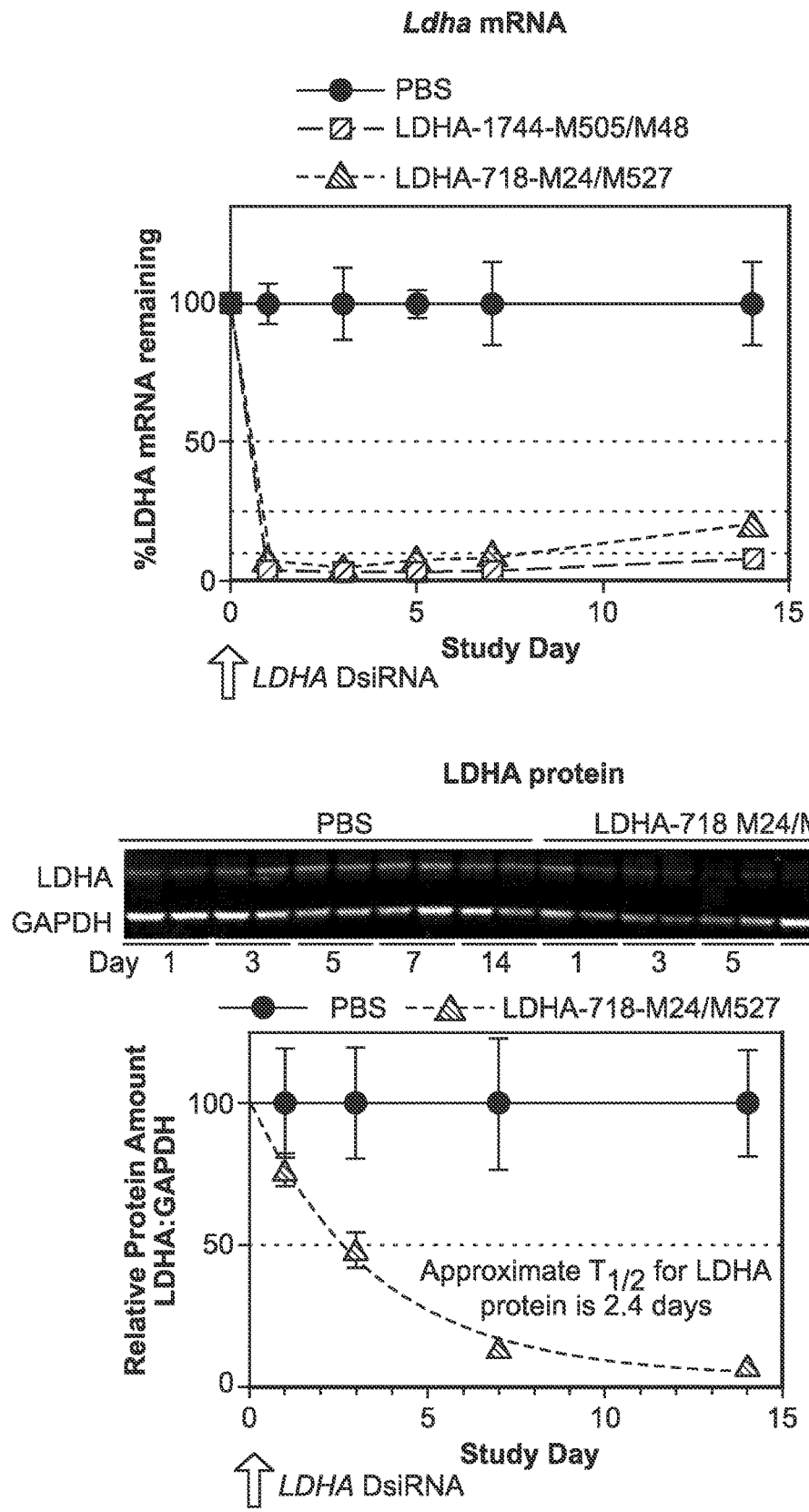
Figure 4C:
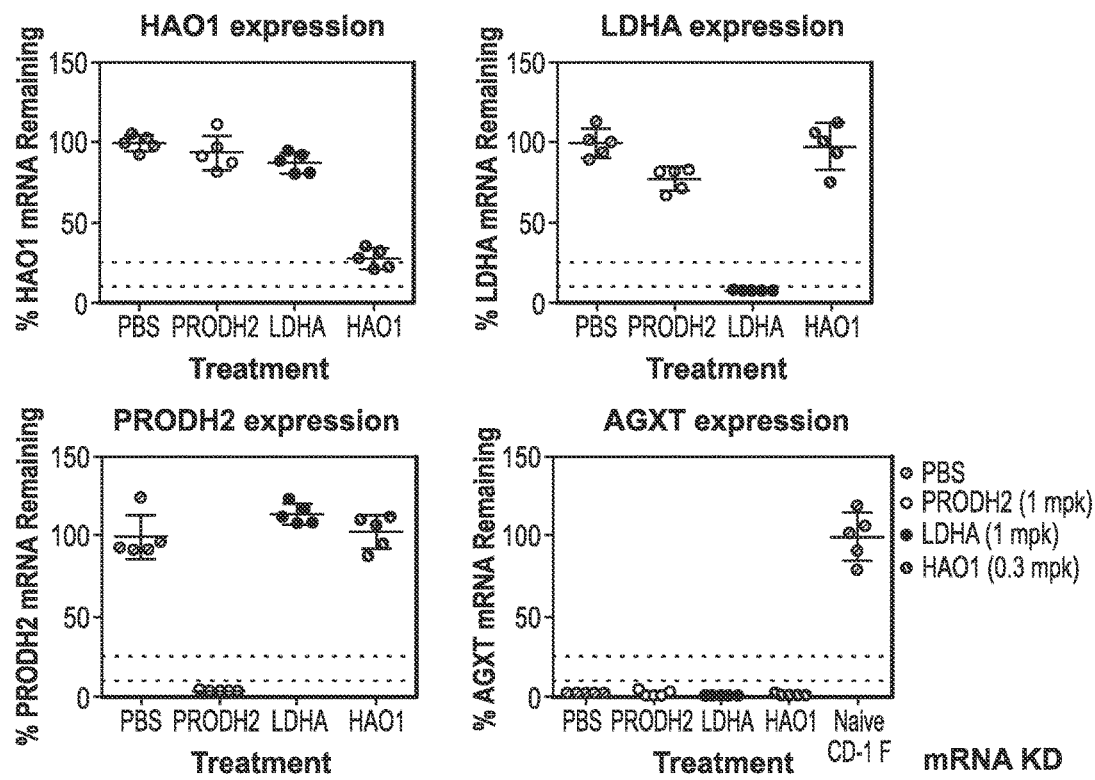
Figure 4C:
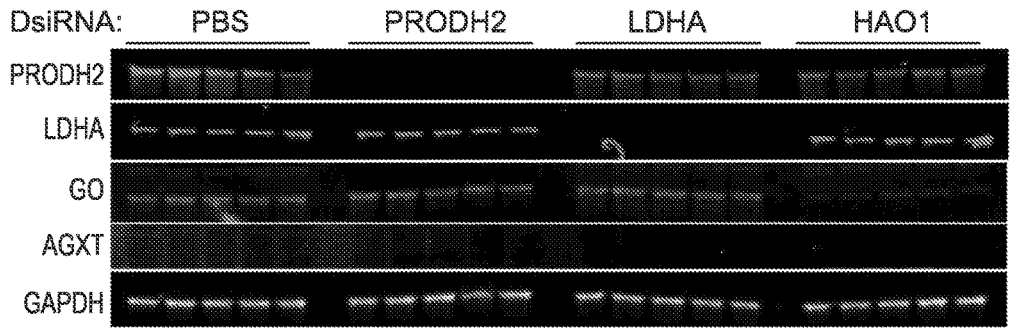
Figure 4C:
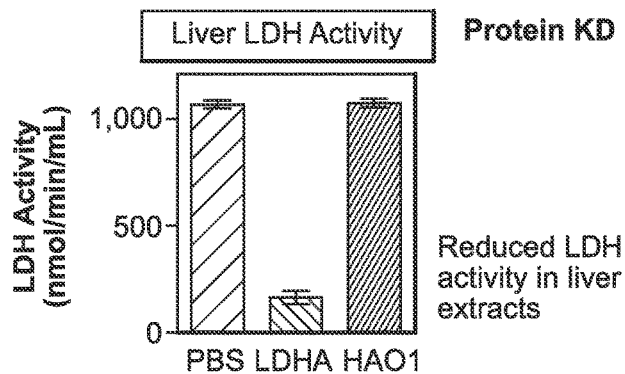

Example 3: Lactate Dehydrogenase-Targeting DsiRNAs were Effective Inhibitors of Both LDHA mRNA and Protein In Vivo The efficacy of LDHA-targeting DsiRNAs to inhibit both LDHA mRNA and protein levels was examined in mice. As shown in FIGS. 4A to 4C, LDHA-targeting DsiRNAs potently inhibited mRNA and protein expression in mouse liver (human-mouse cross-reactive DsiRNAs LDHA-402, LDHA-723 and LDHA-370 possessing M107/M48 modifications were tested for mRNA knockdown, while LDHA-402 protein levels are shown in the right panel of FIG. 4A, relative to a GAPDH control). Specifically, robust knockdown of LDHA mRNA levels was observed at 24 hours post-DsiRNA injection. Meanwhile dramatically reduced levels of LDHA protein were observed in mice administered LDHA-402 DsiRNA, even at 14 days post-i.v. injection at 1 mg/kg.

Example 4: Lactate Dehydrogenase-Targeting DsiRNAs Demonstrated Phenotypic Efficacy in Reducing Oxalate Excretion and in Preventing Ethylene Glycol-Induced Kidney Damage and Calcium Oxalate Crystals in PH1 Model Mice The ability of active lactate dehydrogenase-targeting DsiRNAs to reduce lactate dehydrogenase levels within a mouse model of PH1 was examined, with the specific model employed relying upon pre-treatment of mice with AGXT-targeting DsiRNA (administered with timing of the upper arrows of FIGS. 5A through 5D; alternatively, an AGXT knockout mouse, as described in Hernandez-Fernaud and Salido (*FEBS Journal* 277: 4766-74) or other model of PH1 or other oxalate accumulation disease could have been used).

Figure 5B:
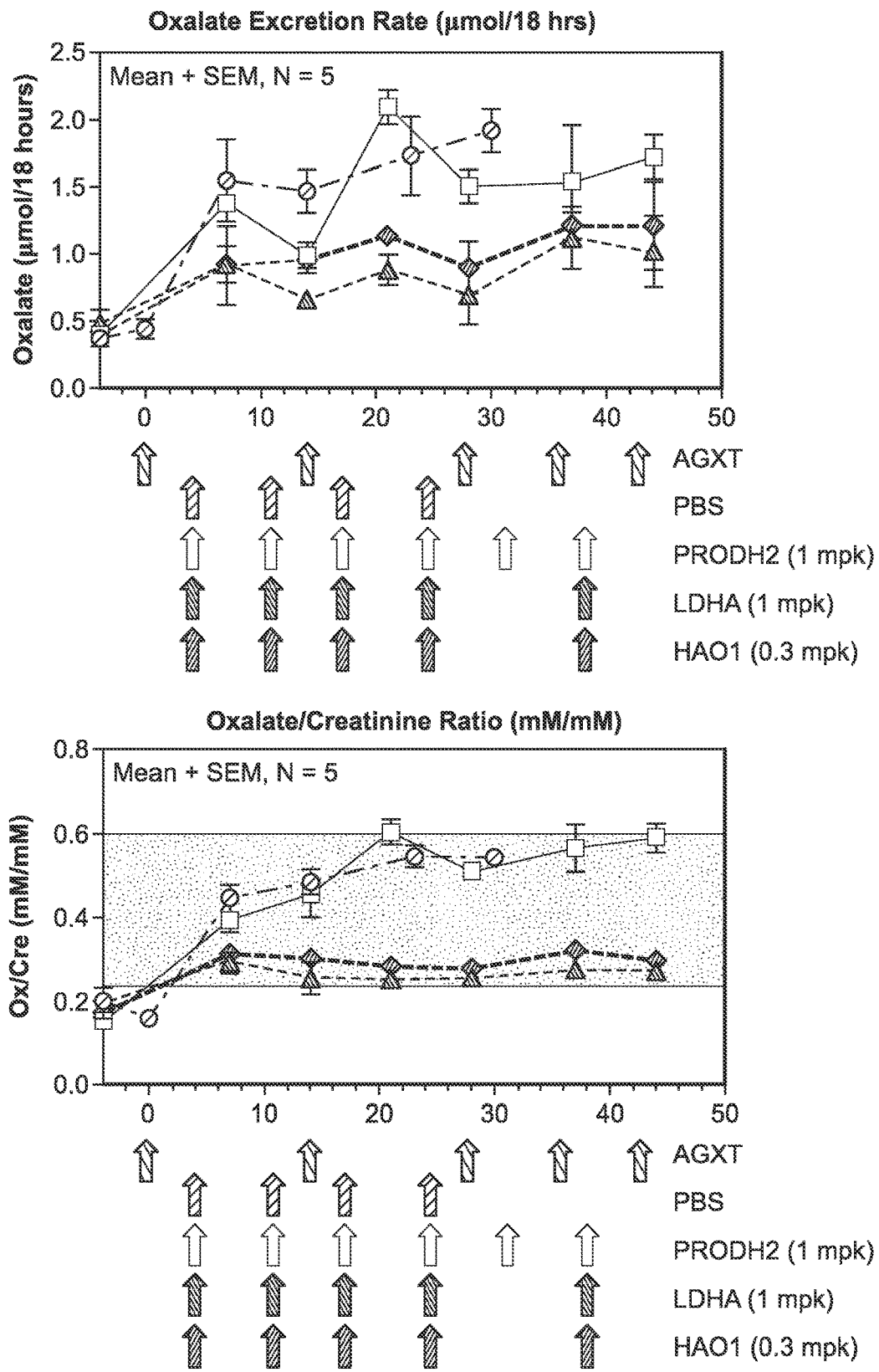
Figure 5C:
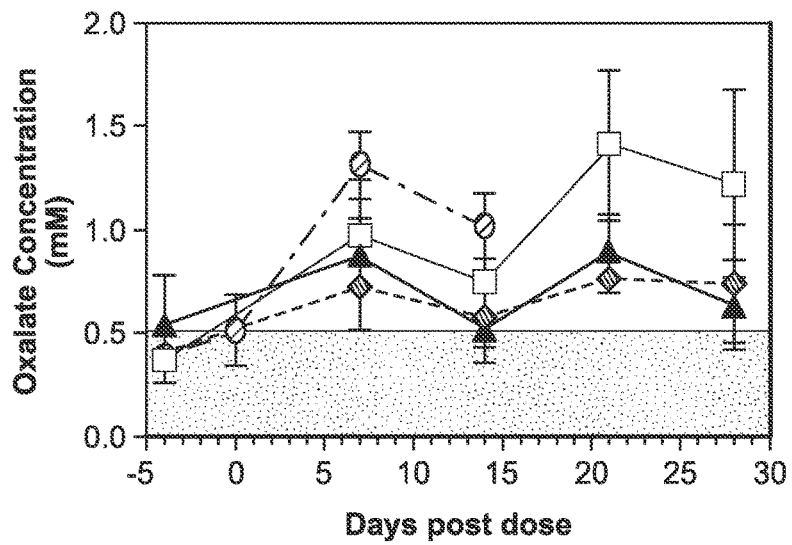
Figure 5C:
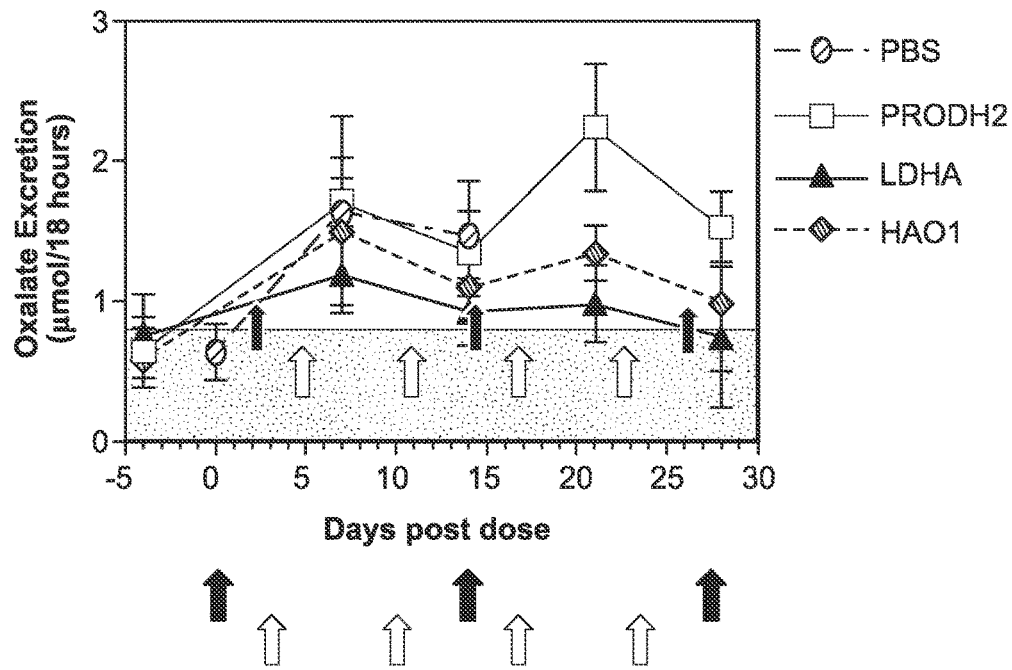
Figure 5D:
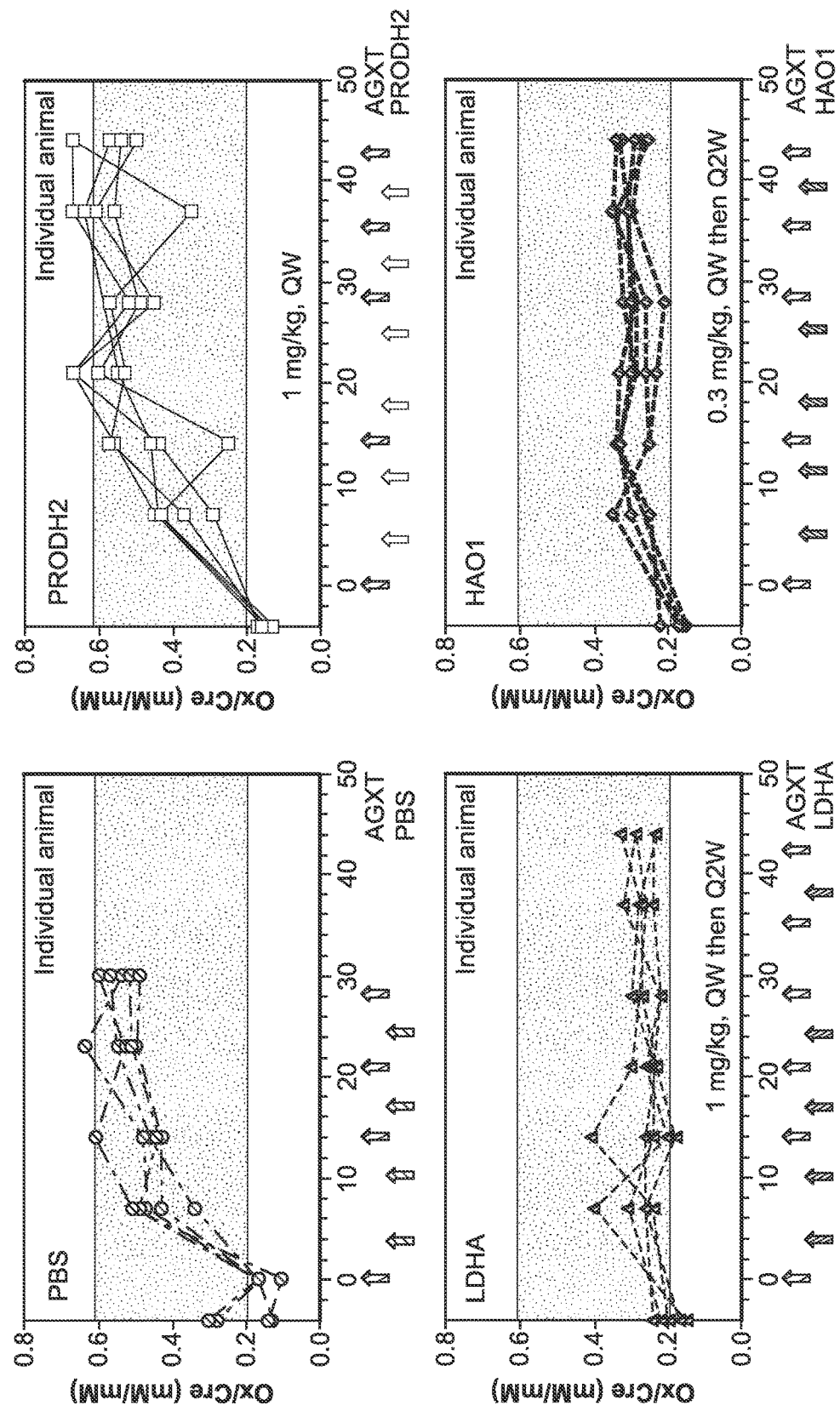
Figure 6:
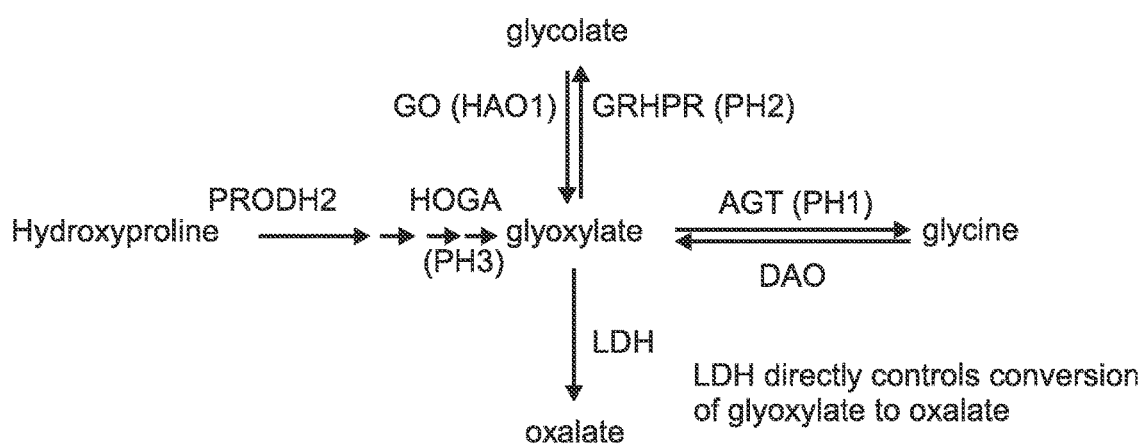
FIG. 6 depicts another schematic overview of the oxalate metabolism pathway. Primary hyperoxaluria (PH, including PH1) has been identified as an autosomal recessive disorder, and LDH (encoded by LDHA in the liver) is noted as controlling the final step of oxalate production. At least in view of its position within the oxalate metabolism pathway, LDHA is identified as a promising therapeutic target for all types of PH.

Animals were randomized and assigned to groups based on marker levels. Dosing of animals with lipid nanoparticles (LNPs) containing indicated DsiRNAs (an LNP formulation named EnCore-2072 was employed) was performed. Animals were dosed at 5 mg/kg iv, at indicated time points (upper arrows being AGXT DsiRNA injections or PBS, while lower arrows indicate LDHA DsiRNA injections, PBS injections, PRODH2 DsiRNA injections or HAO1 DsiRNA injections, as noted in each panel of FIG. 5A). Animals were assayed for oxalate excretion levels, where reduction of oxalate excretion was indicative of an amelioration/reduction of PH1 symptoms. As shown in FIGS. 5A through 5D, intravenous injection of LDHA-targeting DsiRNA reduced oxalate excretion in PH1 model mice (mice pre-treated with AGXT DsiRNA to simulate PH1), as compared to PBS-injected control PH1 model mice, and even as compared to PH1 model mice administered DsiRNAs targeting oxalate metabolism pathway components glycolate oxidase (HAO1) or PRODH2 (proline dehydrogenase (oxidase) 2; see FIG. 6). In each of FIGS. 5A through 5D, mice (n=5/group) were injected on day 0 and day 14 with AGXT-targeting DsiRNA (upper arrows of each series). For results presented in FIGS. 5B and 5D, administration of AGXT-targeting DsiRNA was additionally performed on days 28, 35 and 42. Mice treated with AGXT-targeting DsiRNA were then subjected to intravenous injection of PBS (filled circles of FIGS. 5A to 5D, upper left panels of FIGS. 5A and 5D), anti-PRODH2 DsiRNA (filled squares of FIGS. 5A to 5D, upper right panels of FIGS. 5A and 5D), anti-HAO1 DsiRNA (filled diamonds of FIGS. 5A to 5D, lower left panel of FIG. 5A; lower right panel of FIG. 5D) or anti-LDHA DsiRNA (filled triangles of FIGS. 5A to 5D, lower right panel of FIG. 5A; lower left panel of FIG. 5D), respectively, at days 3, 10, 17 and 24, with FIGS. 5B and 5D showing the impact of additional administrations of such DsiRNAs at days 31 and 38 (anti-PRODH2 DsiRNA) or at day 38 (anti-LDHA DsiRNA or anti-HAO1 DsiRNA). In FIGS. 5A and 5C, oxalate excretion was measured at days 0, 7 and 14 for PBS-treated PH1 model mice, while levels of oxalate excretion were assayed in DsiRNA-treated mice at days −4, 7, 14, 21 and 28. As shown in FIGS. 5B and 5D, extension of the studies respectively shown in FIGS. 5A and 5C was performed, with measurements of levels of oxalate excretion in DsiRNA-treated mice also performed at days 37 and 44. Both PBS- and PRODH2 DsiRNA-treated groups of mice were observed to exhibit dramatically elevated oxalate excretion levels when assayed at day 7 post-AGXT DsiRNA injection. PRODH2 DsiRNA-treated groups of mice were also observed to exhibit further elevated oxalate excretion levels when assayed at day 21 post-initial AGXT DsiRNA injection (while PBS-treated mice were only maintained until day 14; FIG. 5A). HAO1 DsiRNA-treated groups of mice were also observed to exhibit elevated oxalate excretion levels when assayed at day 7 or day 21 post-initial AGXT DsiRNA injection, though the levels of such elevations appeared to be reduced as compared to PBS-treated or PRODH2 DsiRNA-treated PH1 model mice (FIG. 5A). These results largely persisted through extended assessments; however, anti-HAO1 DsiRNA treatment more closely resembled anti-LDHA DsiRNA treatment at extended timepoints (FIG. 5B).

Remarkably, treatment of PH1 model mice with an LDHA-targeting DsiRNA under the same injection schedule described above (LDHA-402-M107/M48 DsiRNA in LNP 2185, administered by intravenous injection, where AGXT-m1533-M107/M48 in LNP 2185 was also administered by intravenous injection, at 1 mg/kg) revealed dramatic inhibitions of oxalate elevation at day 7, day 21 and later timepoints post-initial AGXT DsiRNA injection. Thus, reduced levels of LDHA mRNA and protein (as demonstrated in FIGS. 4A to 4C above) also translated into phenotypic effects in inhibiting elevation of oxalate excretion in PH1 model mice. FIGS. 5C and 5D show that all DsiRNAs tested in PH1 model mice (PRODH2-, HAO1- and LDHA-targeting DsiRNAs) showed at least some inhibitory impact upon oxalate concentration (e.g., left panel of FIG. 5C). However, LDHA-targeting DsiRNA demonstrated the greatest reduction of oxalate excretion, even as compared to HAO1-targeting DsiRNA. Such results indicated that reduction of oxalate concentration was necessary but not sufficient to observe downregulation of oxalate excretion.

Figure 5E:
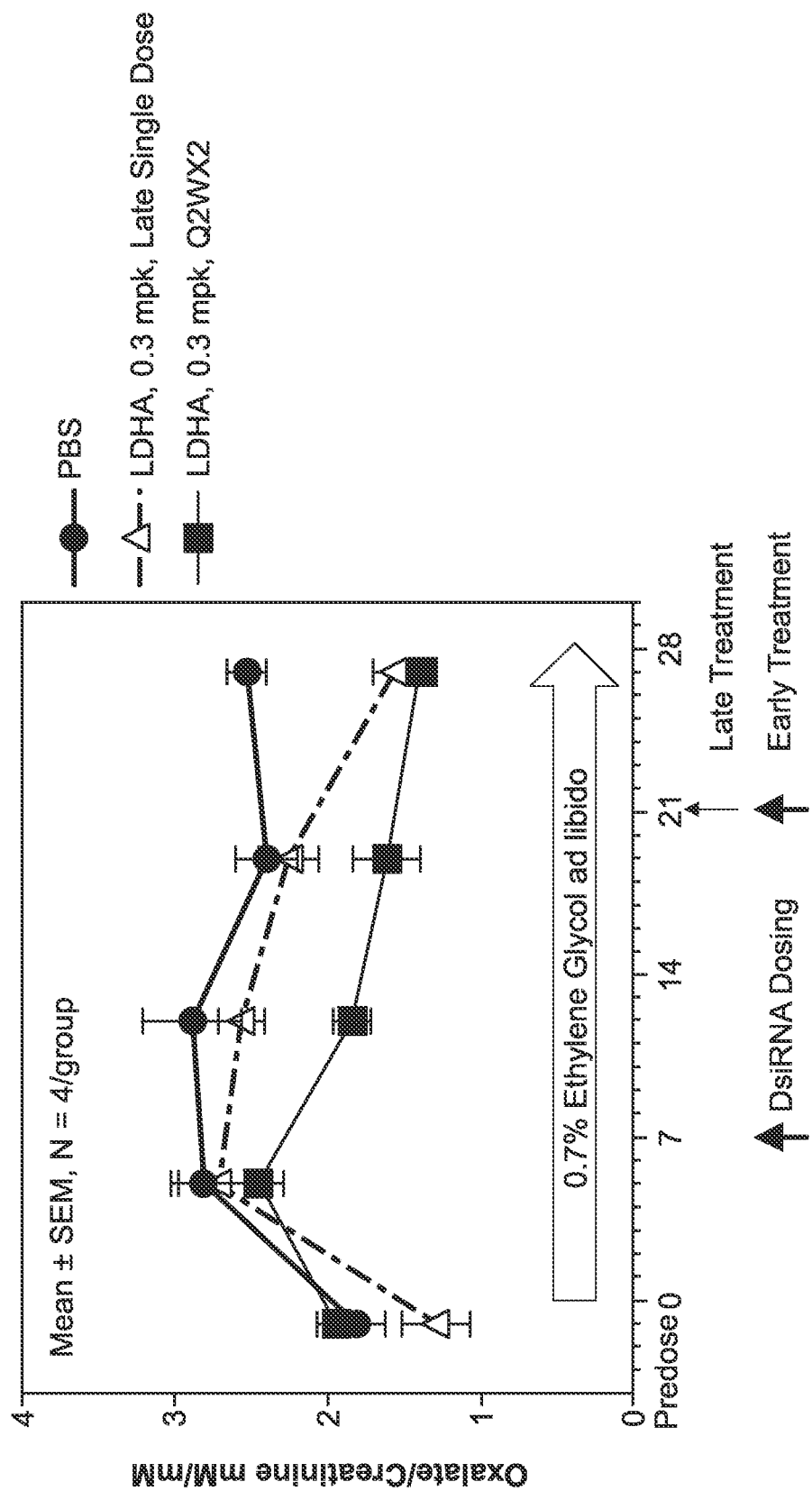
FIGS. 5E to 5G show that intravenous injection of LDHA-targeting DsiRNA also exerted a protective effect in Agxt$^{-/-}$ mice with respect to reducing urine oxalate levels, preventing ethylene glycol-induced kidney damage and preventing ethylene glycol-induced calcium oxalate crystals.
Figure 5F:
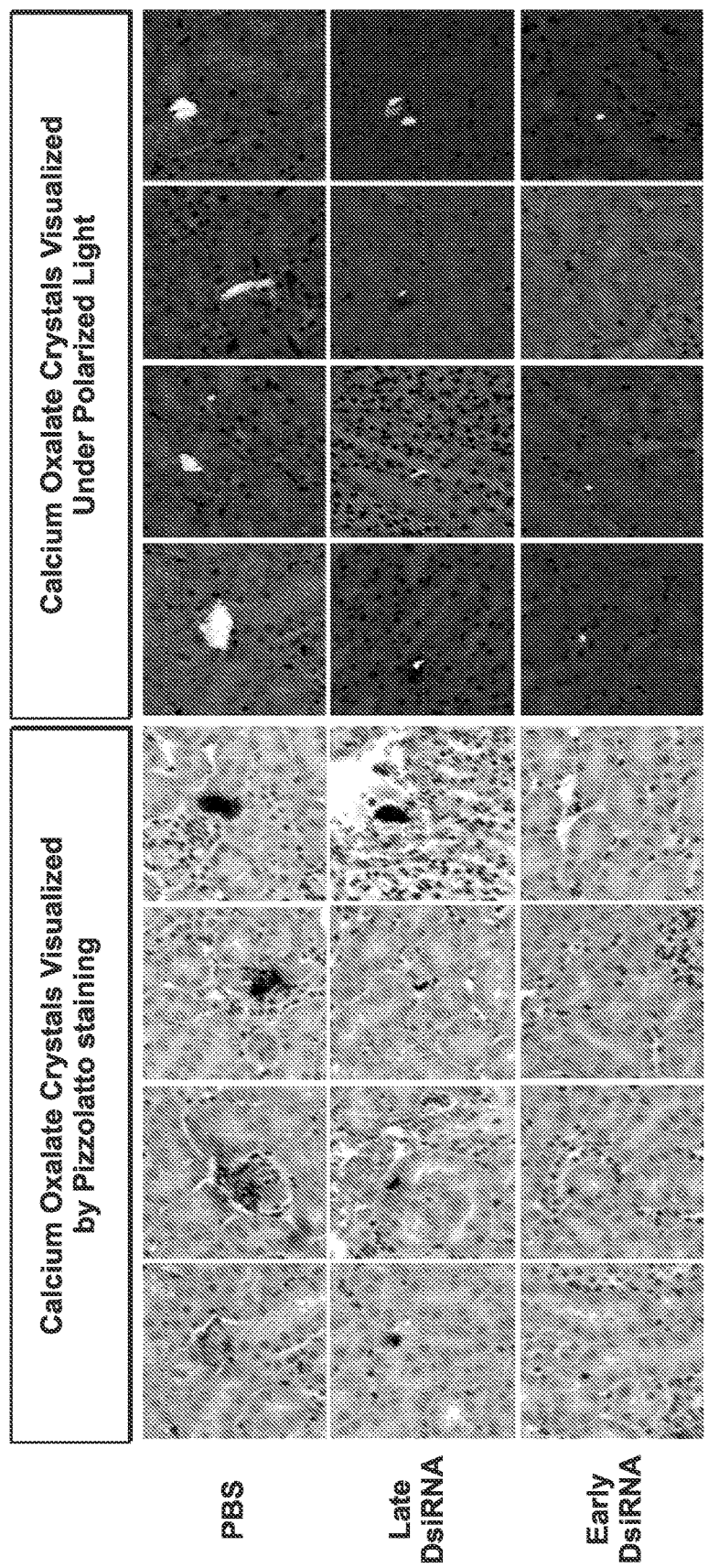
Figure 5G:
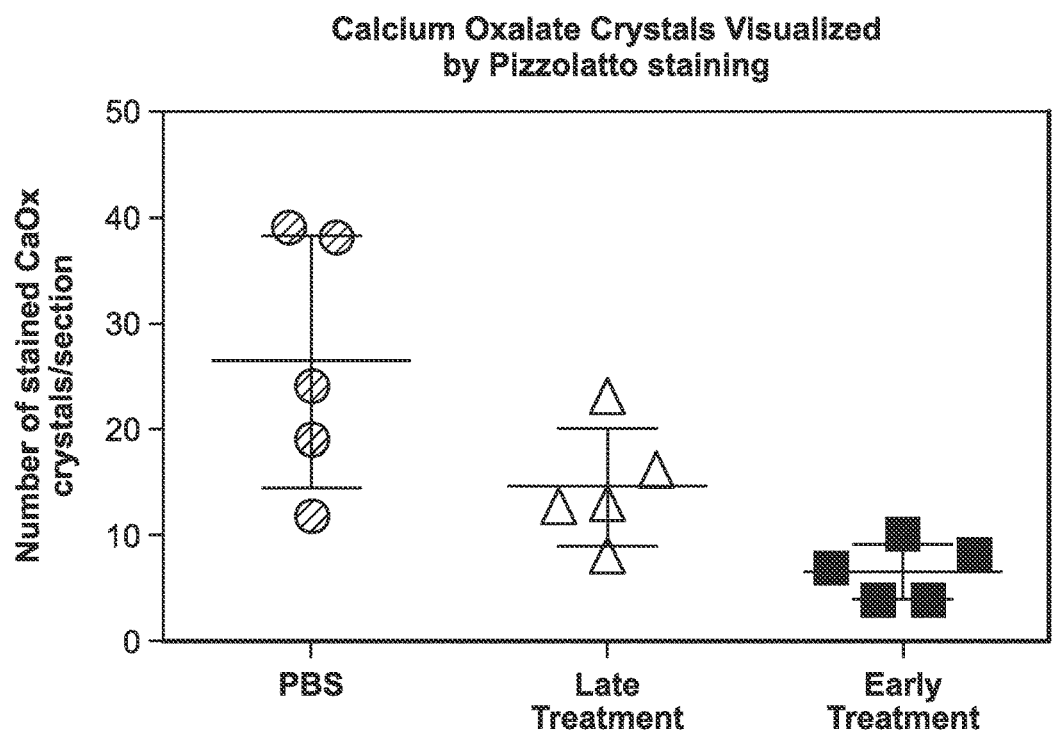
Figure 5G:
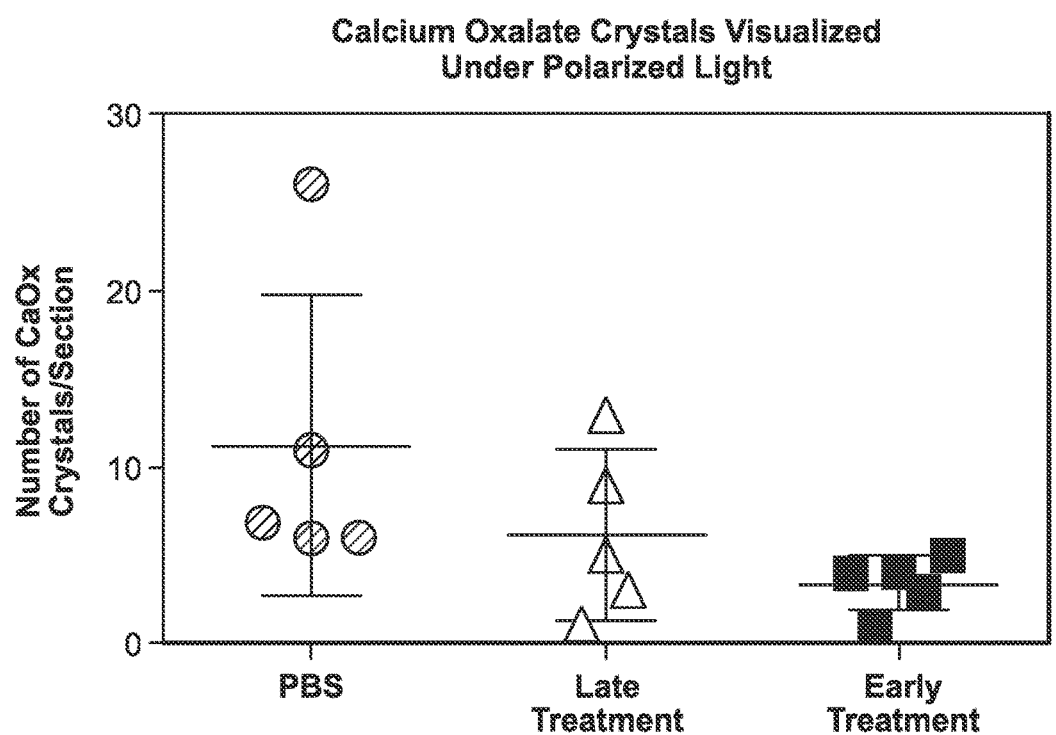

The impact of anti-LDHA DsiRNA treatment of $Agxt^{-/-}$ mice was assessed after challenge with ethylene glycol (a PH1 model). As shown in FIG. 5E, when $Agxt^{-/-}$ mice were challenged with ethylene glycol, LDHA DsiRNA administration (specifically, LDHA-718-M24/M527 (DP2685P: DP2692G) in 2185 LNP) was observed to reduce urine oxalate levels. As shown in FIGS. 5F and 5G, administration of LDHA DsiRNA (LDHA-718-M24/M527 (DP2685P: DP2692G) in 2185 LNP) was observed to prevent ethylene glycol-induced kidney damage and prevent ethylene glycol-induced calcium oxalate crystals in $Agxt^{-/-}$ mice.

Thus, in vivo results in PH1 model mice confirmed LDHA as a promising therapeutic target for gene silencing approaches (e.g., RNAi approaches), not only for PH1 but also for all types of PH.

Figure 5H:
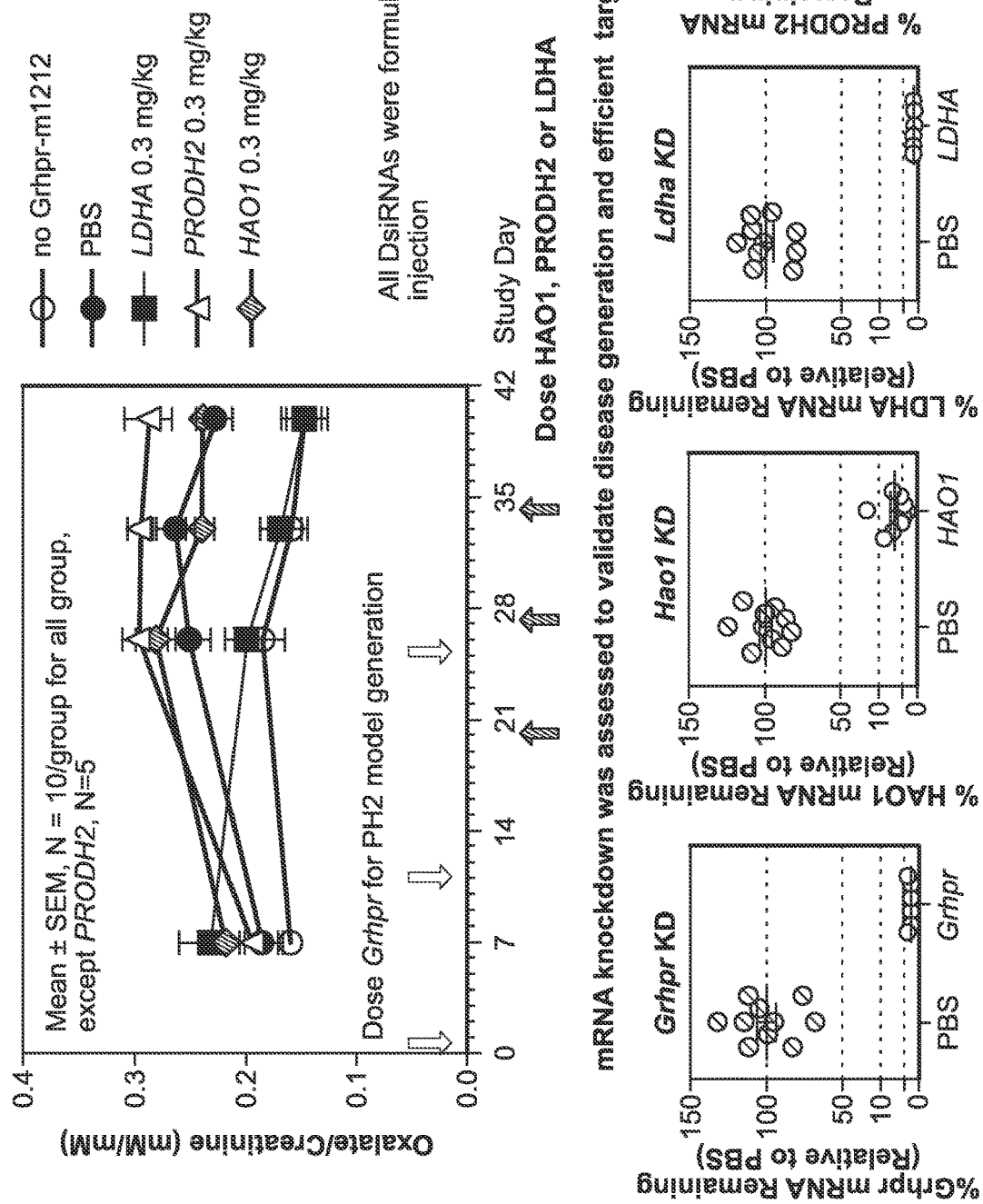
FIG. 5H shows that intravenous injection of LDHA-targeting DsiRNA reduced urine oxalate levels in PH2 model mice, in contrast to HAO1- and PRODH2-targeting DsiRNAs, which did not reduce urinary oxalate levels in the PH2 model mice.

Example 5: Lactate Dehydrogenase-Targeting DsiRNAs Also Effectively Reduced Urine Oxalate Levels in PH2 Model Mice A mouse model of PH2 was produced via DsiRNA-mediated knockdown of Grhpr (refer to FIG. 6 for role of Grhpr). To examine the efficacy of anti-LDHA DsiRNA treatment of PH2 in the PH2 model system, as well as to assess whether anti-LDHA DsiRNA treatment would exert a more pronounced impact upon PH2 than DsiRNAs targeting other components of the glyoxylate/oxalate pathway, anti-LDHA DsiRNA injection was compared with anti-PRODH2 DsiRNA injection and anti-HAO1 DsiRNA injection. As shown in FIG. 5H, intravenous injection of LDHA-targeting DsiRNA significantly reduced urine oxalate levels in PH2 model mice, in contrast to HAO1- and PRODH2-targeting DsiRNAs, which did not reduce urinary oxalate levels in the PH2 model mice. Thus, anti-LDHA DsiRNA treatment of PH2 was especially effective as compared to DsiRNAs targeting other components of the glyoxylate/oxalate pathway.

Figure 7A:
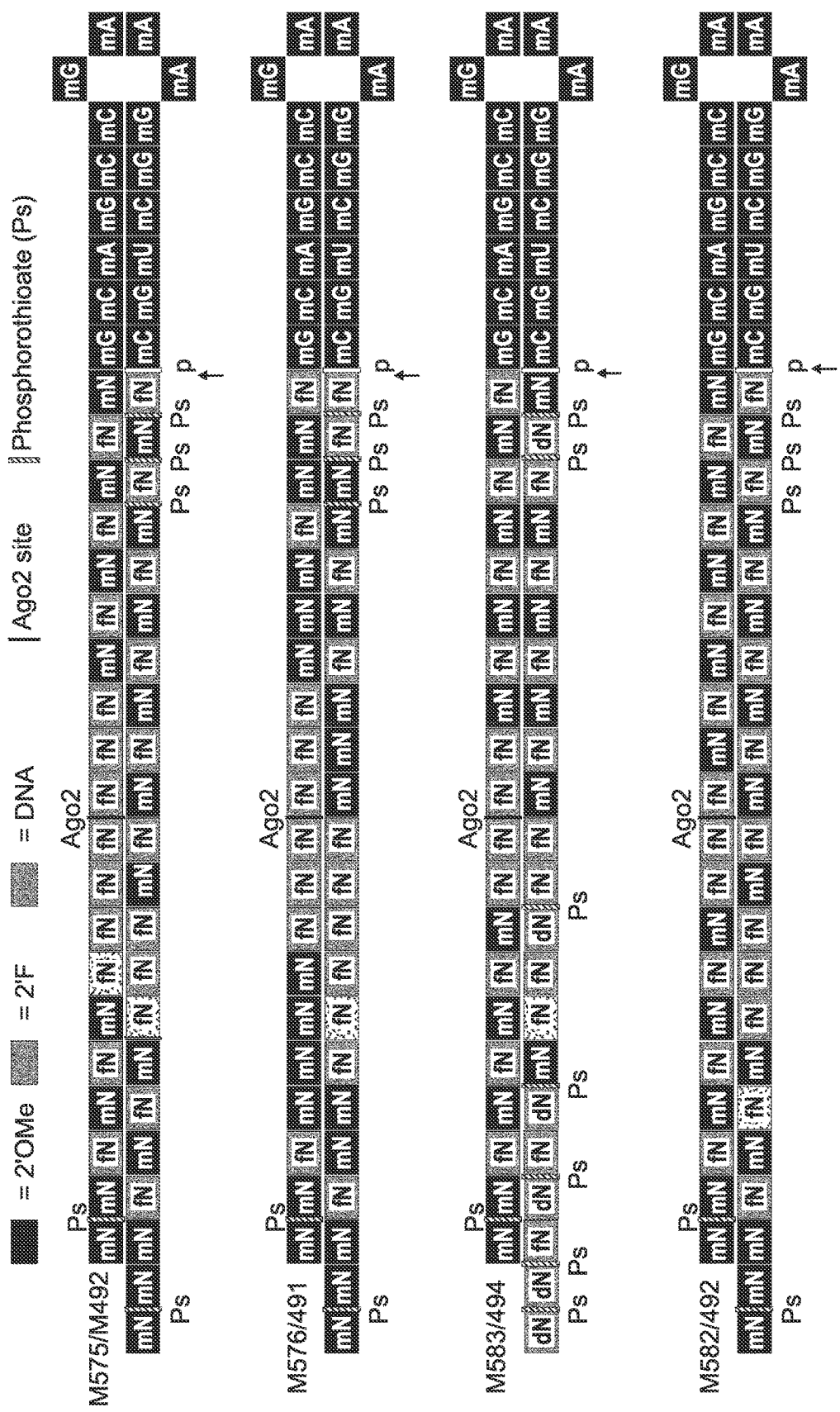
FIGS. 7A to 7C show modification patterns and tetraloop extensions used in synthesizing tetraloop-extended versions of LDHA-targeting DsiRNAs LDHA-718, LDHA-723 and LDHA-1360, as well as results obtained in testing such constructs for efficacy. "Ps" indicates a phosphorothioate linkage, while "p" indicates a terminal phosphate (with an arrow indicating the terminal residue of the second oligonucleotide strand (the non-tetraloop-possessing strand).

Example 6: Efficacy of Tetraloop-Extended Forms of LDHA-Targeting Dicer Substrates A selection of active DsiRNAs identified in the above Examples were used to synthesize corresponding tetraloop-possessing forms of such Dicer substrate molecules. FIG. 7A shows tetraloop sequences and modification patterns employed in such experiments. This mini-set of four modification and tetraloop-possessing construct structures had been validated for in vivo efficacy in HAO1-targeting constructs. The identified modification patterns and tetraloop-containing constructs were synthesized for DsiRNAs LDHA-718 (possessing a target sequence common to humans, rhesus and mouse, with respective tetraloop-containing passenger and guide strand sequences of SEQ ID NOs: 7214 and 7215), LDHA-723 (possessing a target sequence common to humans, rhesus and mouse) and LDHA-1360 (possessing a target sequence common to humans and rhesus).

Figure 7B:
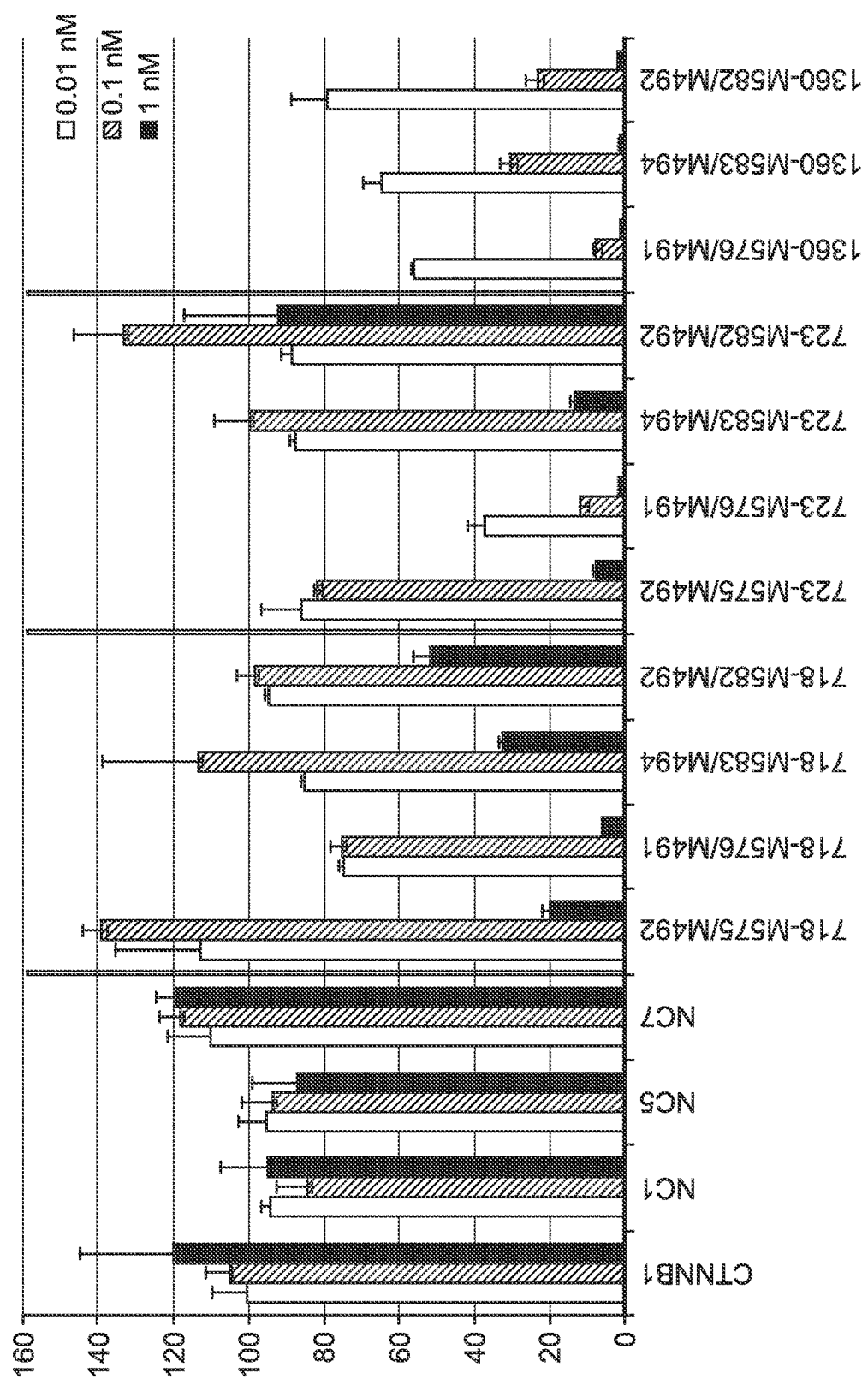
Figure 7C:
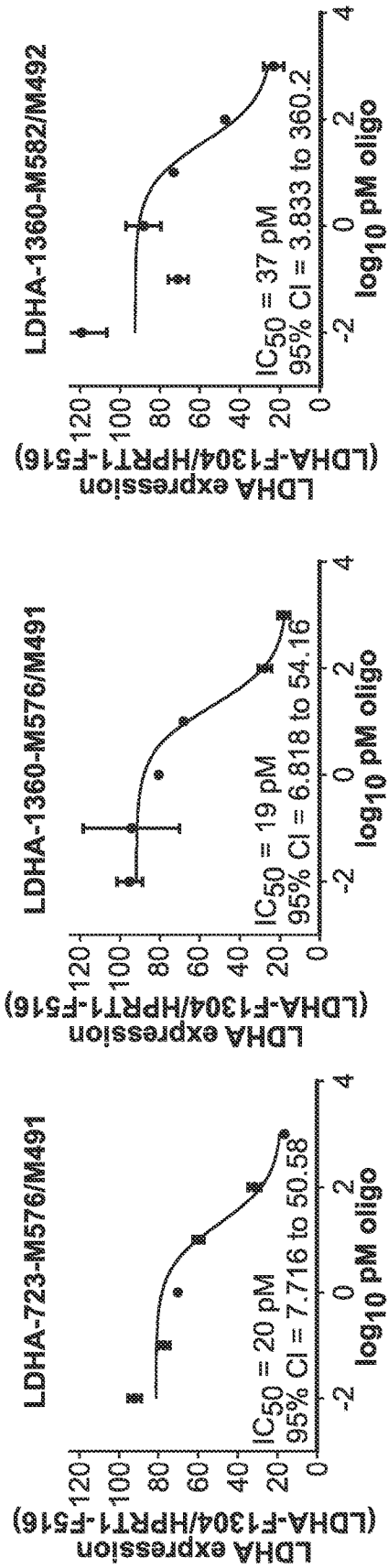
Figure 7C:
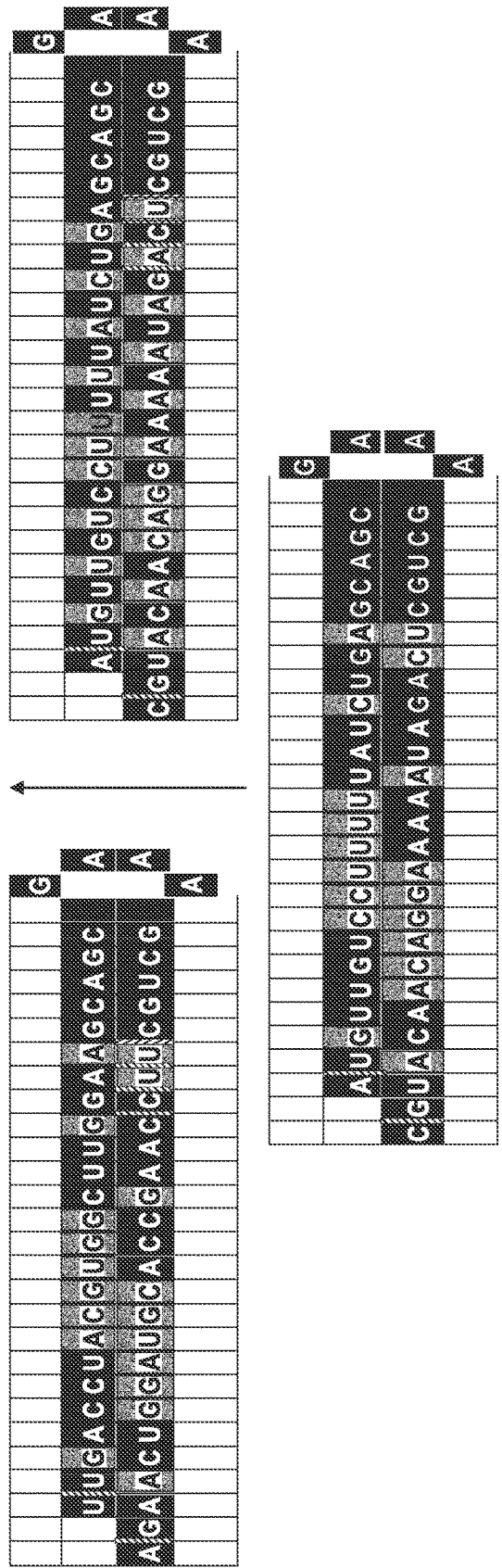

In vitro activities of the tetraloop constructs were examined in HeLa cells. As shown in FIG. 7B, the "M576/M491" modification pattern DsiRNAs possessing tetraloop sequences were identified as having robust LDHA knockdown properties in vitro across each of LDHA-718, LDHA-723 and LDHA-1360 targets, with approximately 50% or greater knockdown observed for LDHA-723 and LDHA-1360 constructs even at extremely low (0.01 nM) concentrations. As shown in FIG. 7C, dose-response curves were also obtained for tetraloop-possessing constructs derived from LDHA-723 and LDHA-1360 DsiRNAs. $IC_{50}$ values were calculated, and robust tetraloop-possessing LDHA-723 and LDHA-1360 structures were identified. The LDHA-723-M576/M491 modified tetraloop agent, identified to have an $IC_{50}$ of 20 pM, was selected for scale-up and conjugation (e.g., to GalNAc moieties), as it was potent and stable. It was also noted that the LDHA-1360 (possessing a target sequence common to humans and rhesus) tetraloop construct tolerated all modification patterns.

Figures 1, 8A:
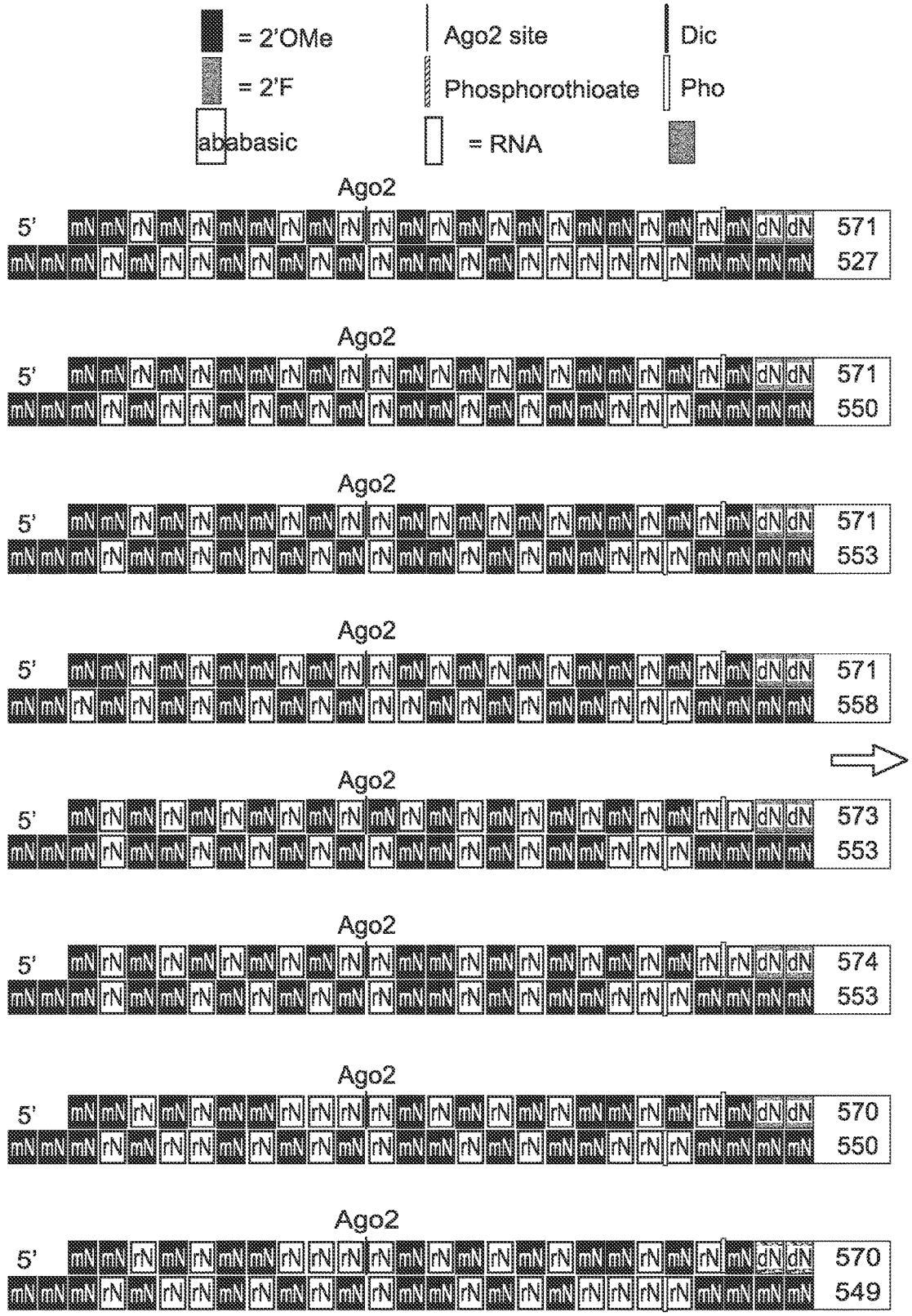
FIGS. 8A to 8C show a set of tetraloop-possessing structures/modification patterns that were applied to the LDHA-targeting DsiRNAs, and efficacy data for such constructs. Tested pairs of oligonucleotide sequences comprising tetraloop-containing agents LDHA-355, LDHA-360, LDHA-361, LDHA-367, LDHA-370, LDHA-399, LDHA-402, LDHA-719 and LDHA-892 are SEQ ID NOs: 7196 and 7197; SEQ ID NOs: 7198 and 7199; SEQ ID NOs: 7200 and 7201; SEQ ID NOs: 7202 and 7203; SEQ ID NOs: 7204 and 7205; SEQ ID NOs: 7206 and 7207; SEQ ID NOs: 7208 and 7209; SEQ ID NOs: 7210 and 7211; and SEQ ID NOs: 7212 and 7213, respectively.
Figures 2, 8A:
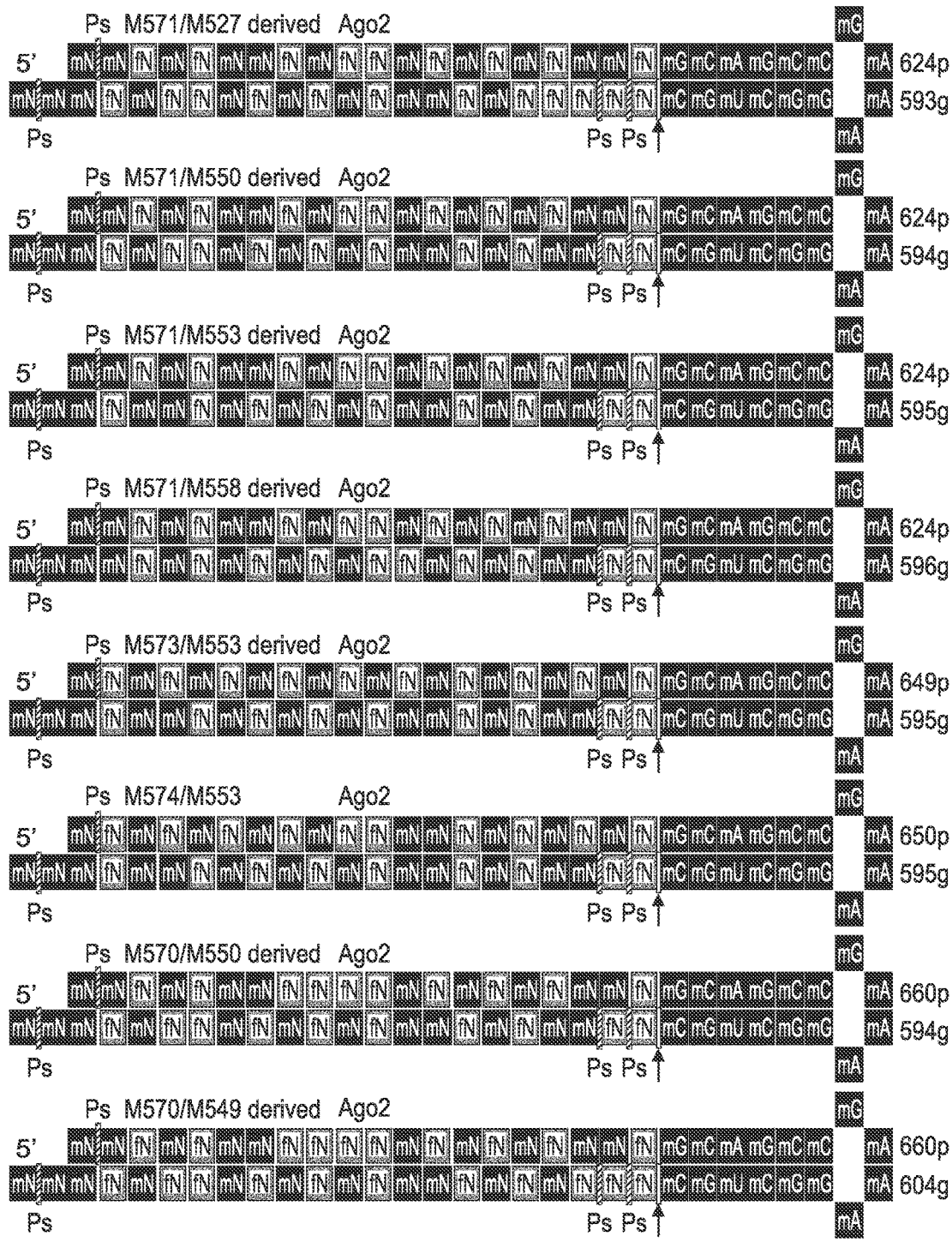
Figures 1, 8B:
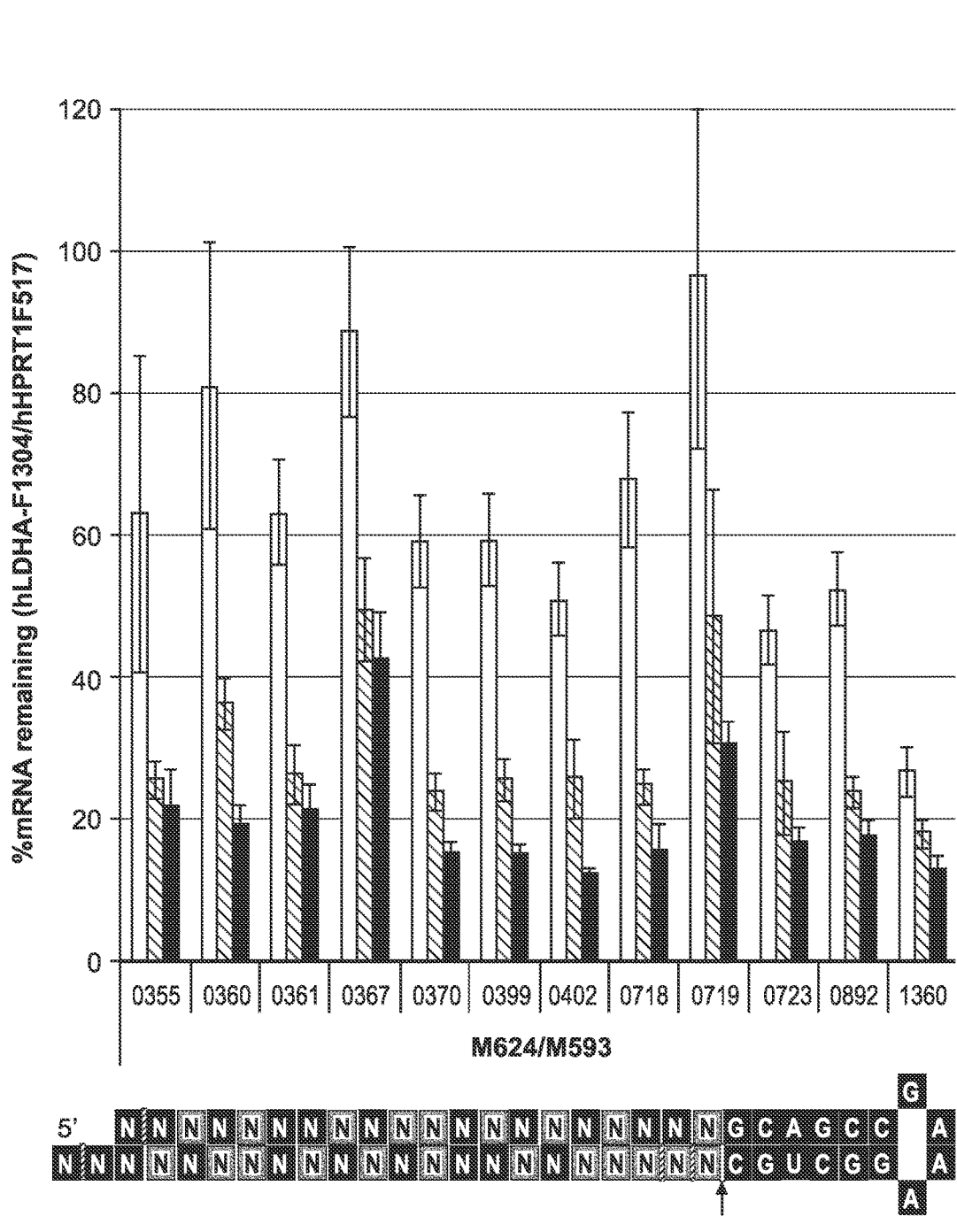
Figures 2, 8B:
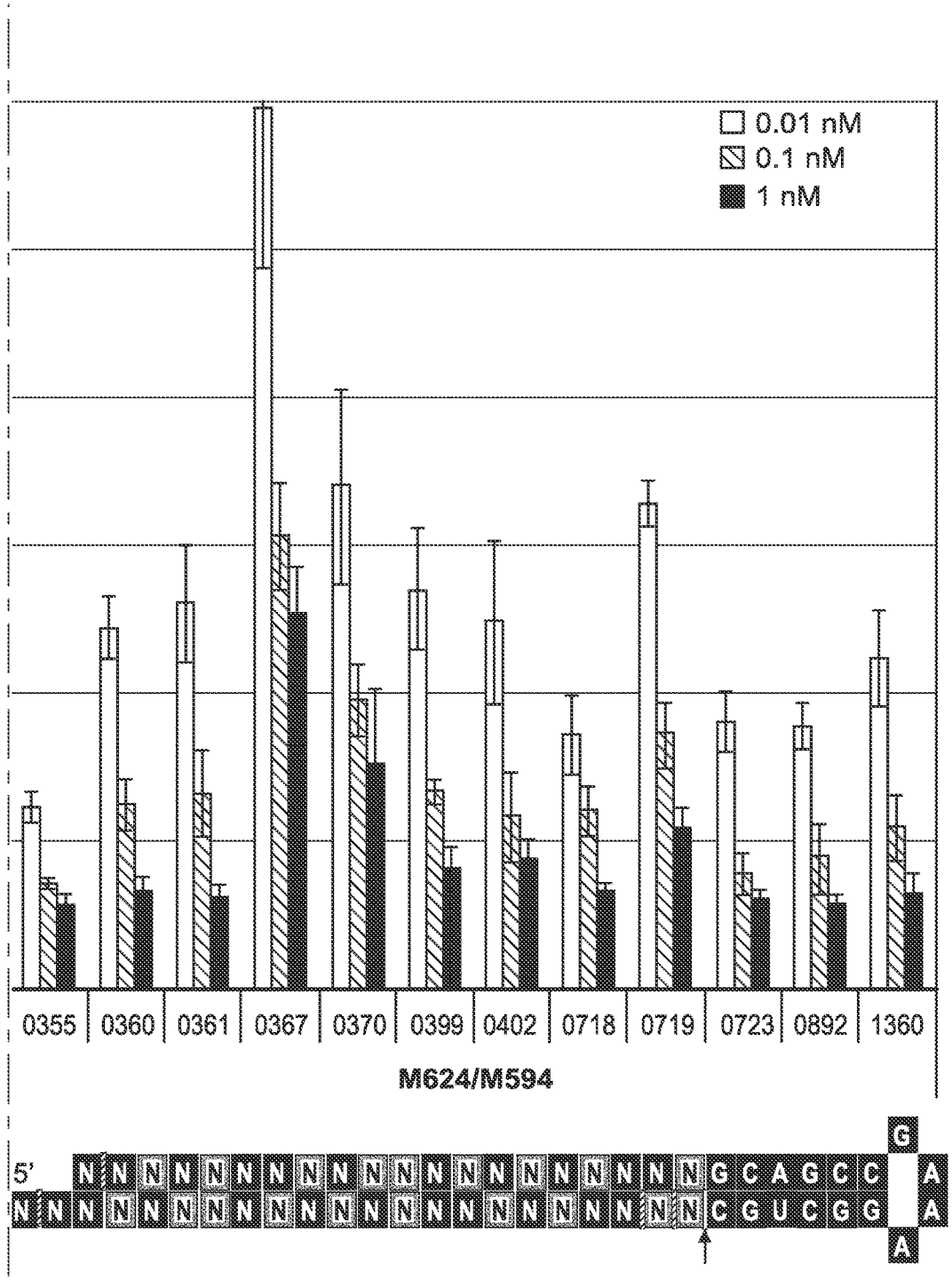
Figures 1, 8C:
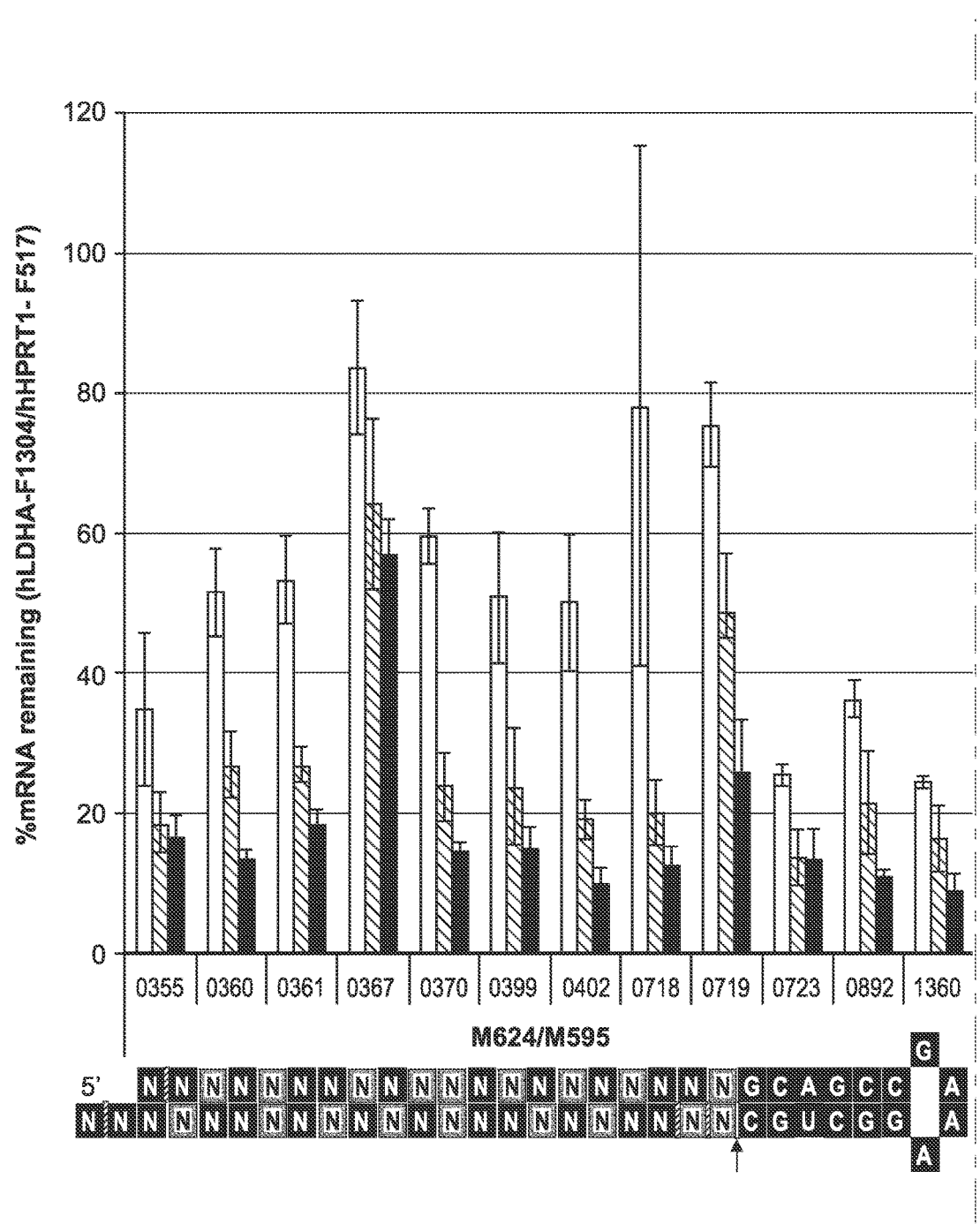
Figures 2, 8C:
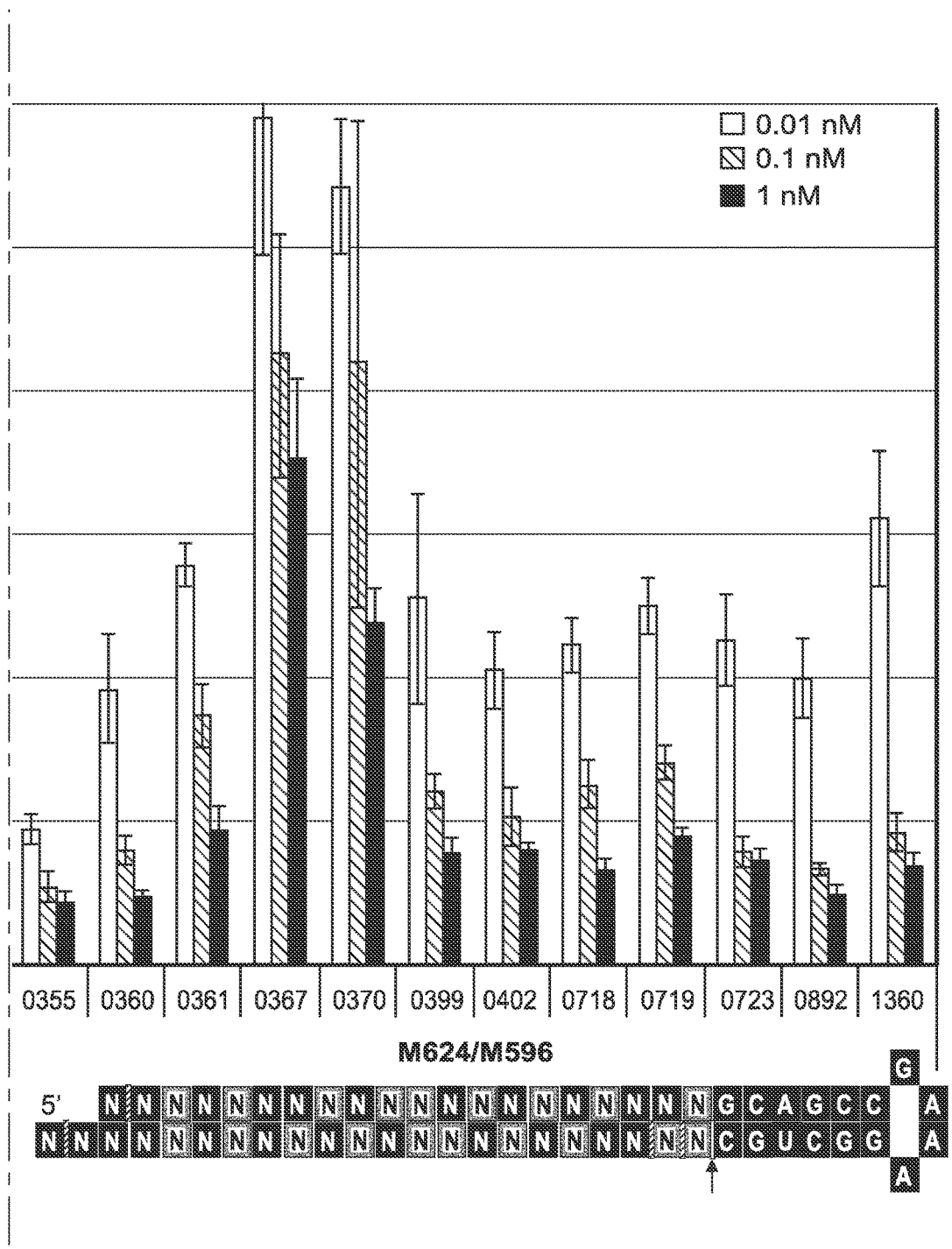
Figures 1, 8D:
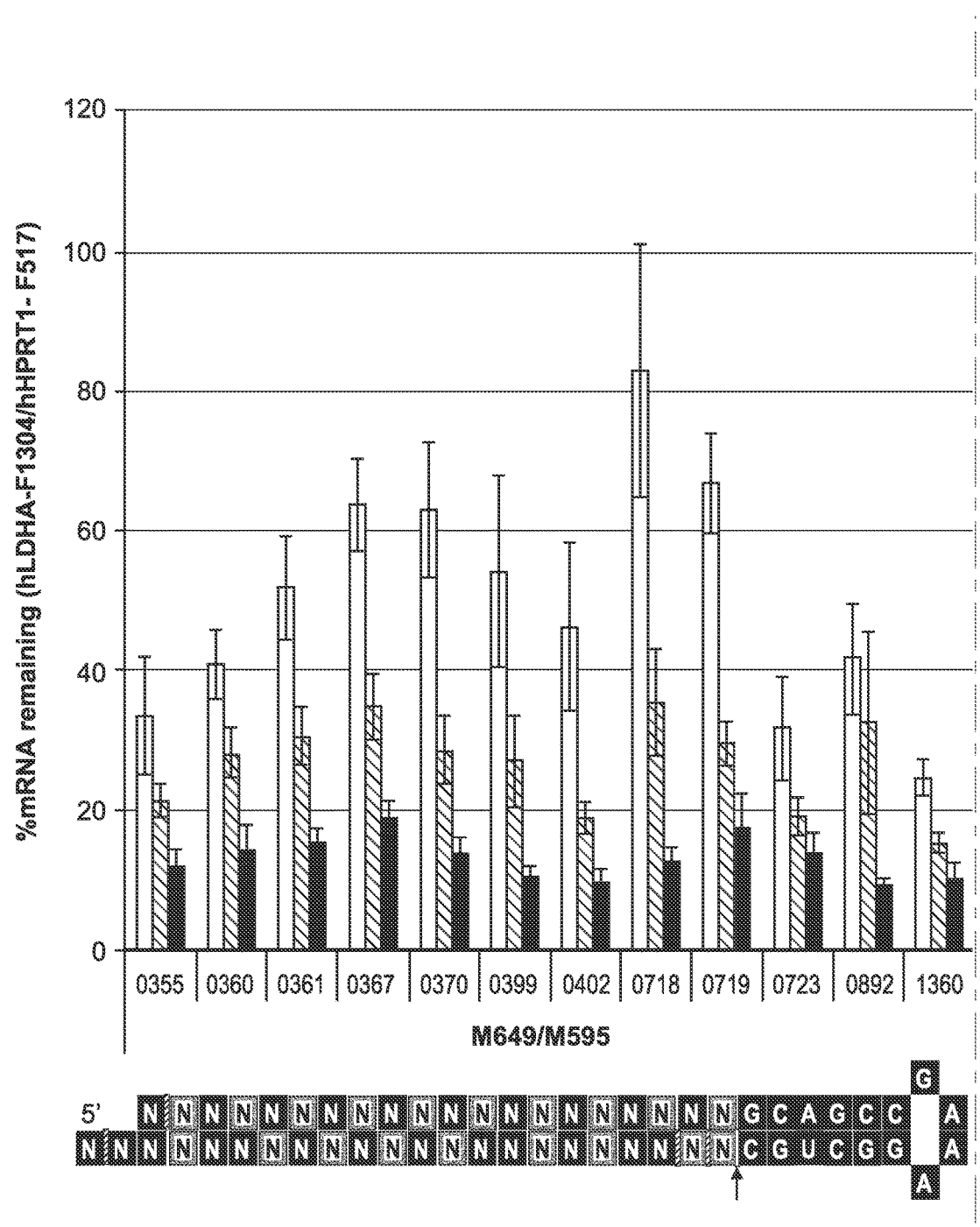
Figures 2, 8D:
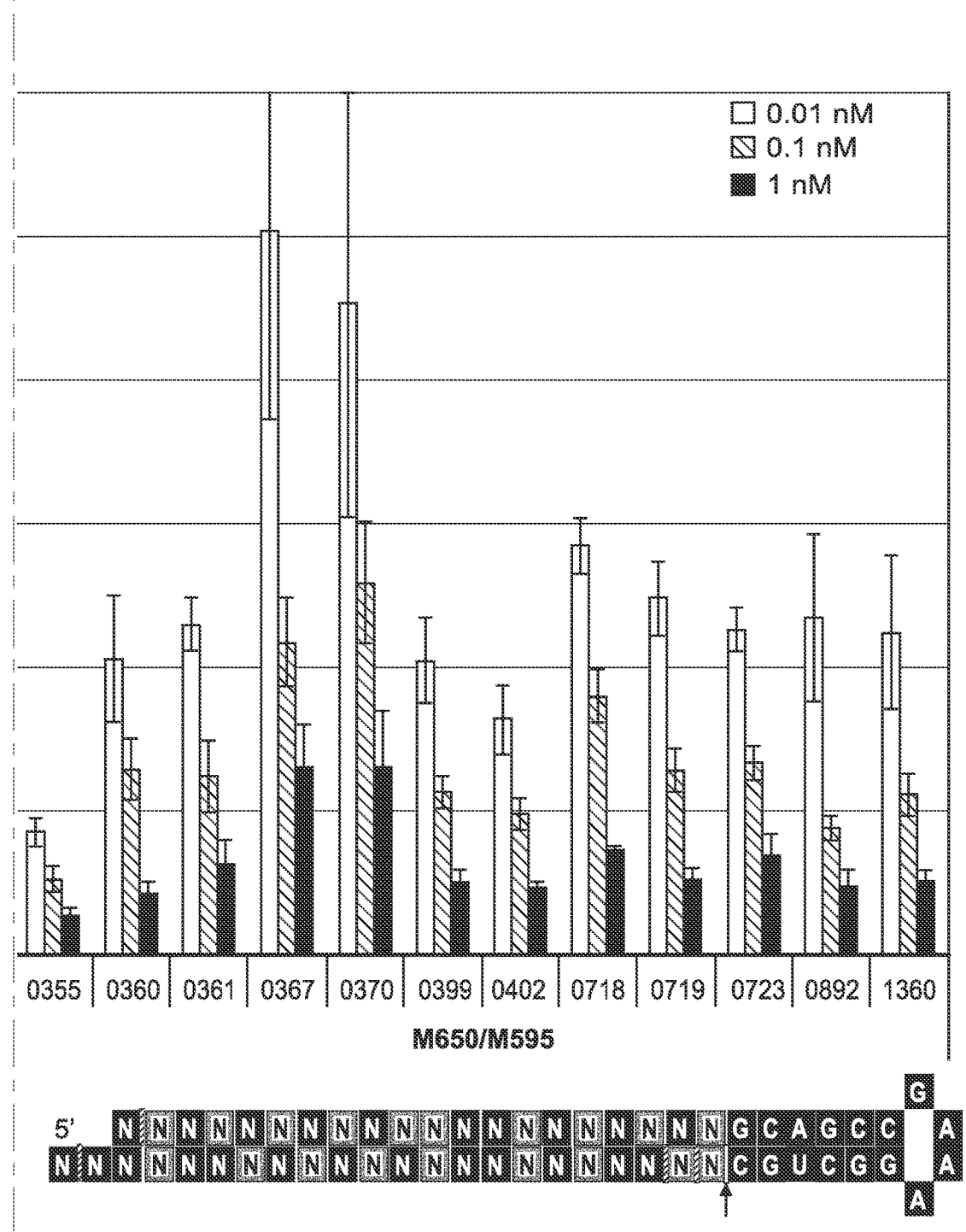
Figures 1, 8E:
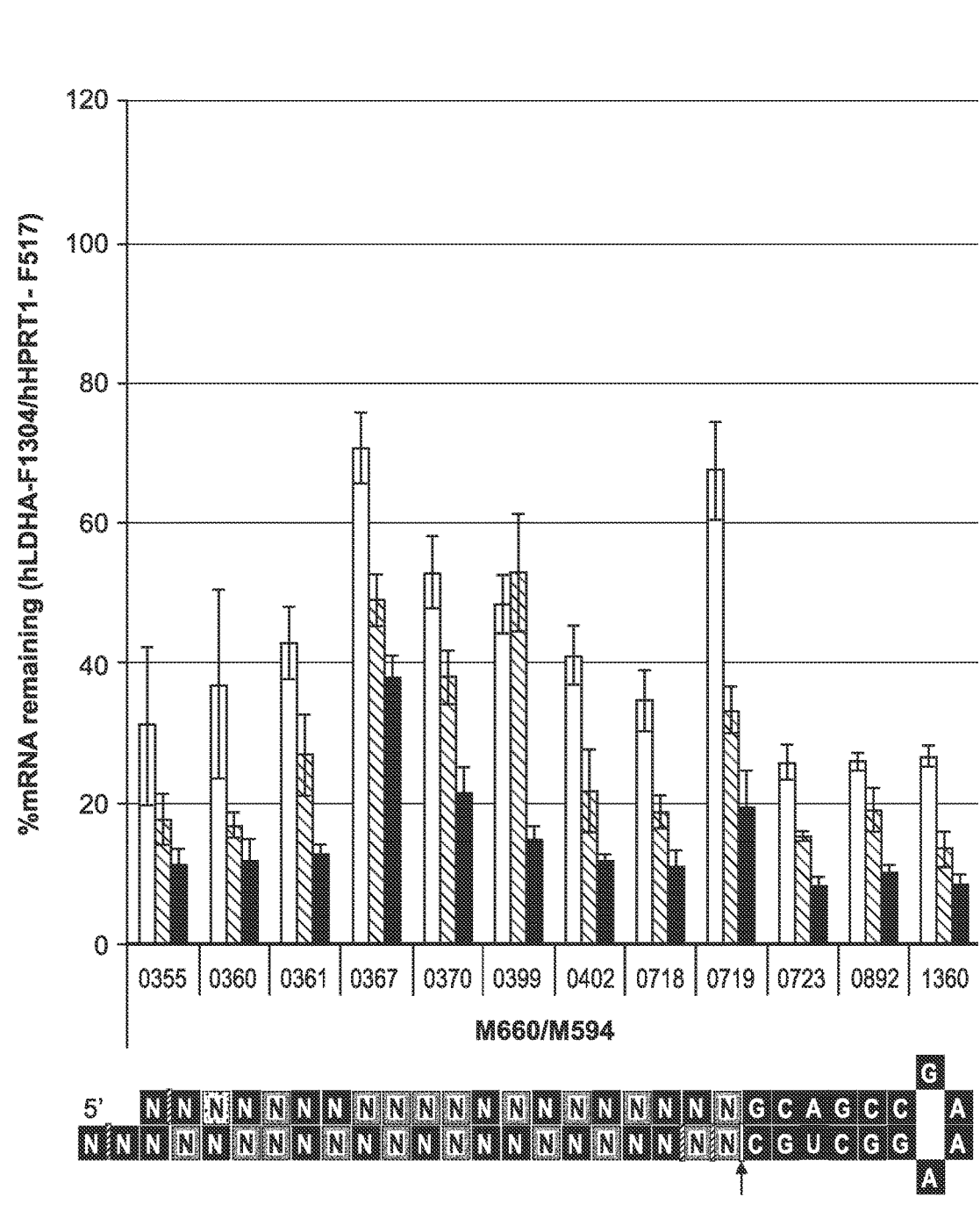
Figures 2, 8E:
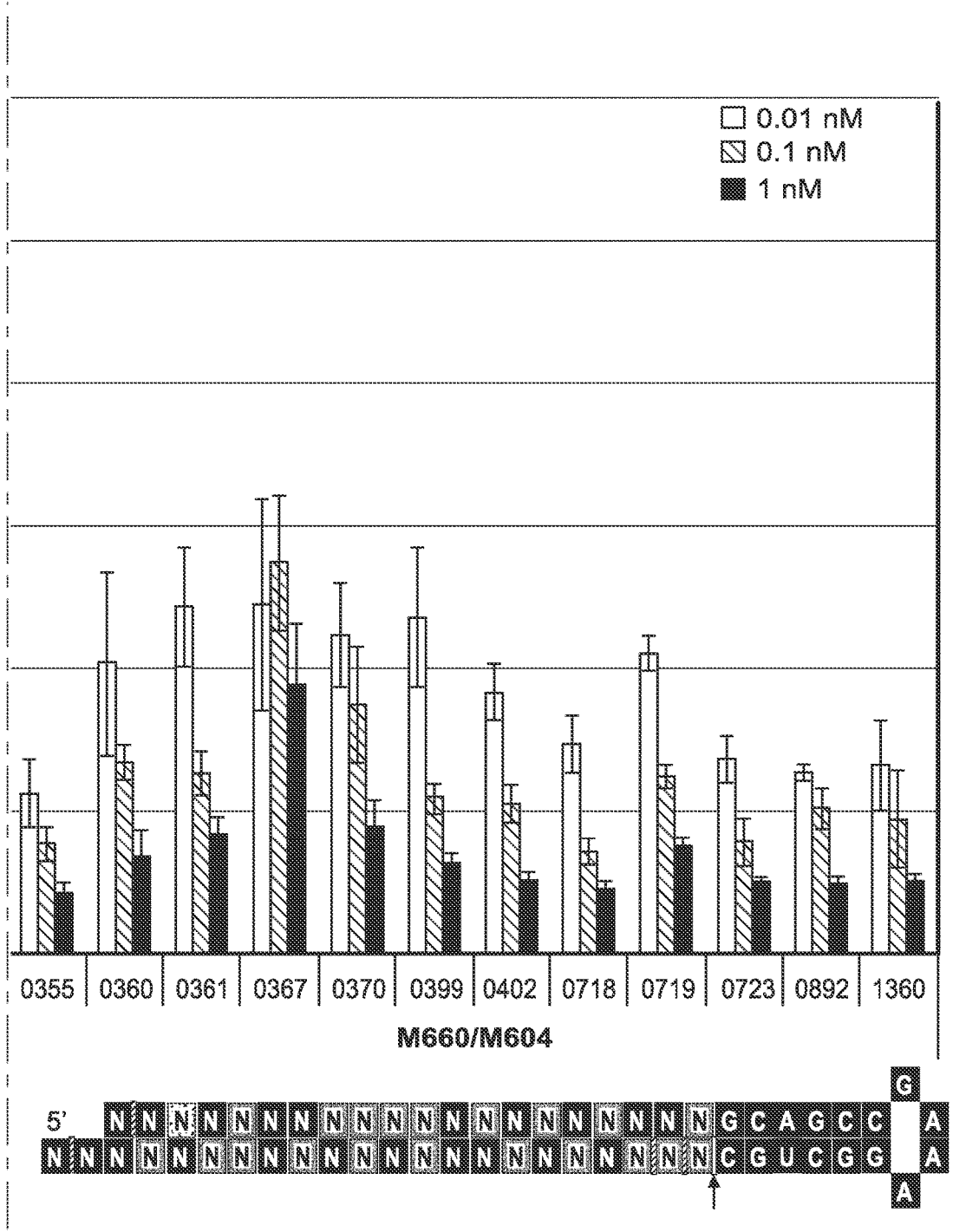

A broader screen for tetraloop-possessing agents that were both active and stable was also performed. In such experiments, previously unmodified residues within 25/27mer modification patterns were converted to 2'-F-modified residues, phosphorothioate linkages and tetraloop structures were added, in a "2'-F fill tetraloop screen". One goal of such a screen was to use 2'-O-Methyl modification pattern screening results to derive potent and stable LDHA tetraloop constructs. To this end, the most active 2'-O-methyl modification patterns for LDHA-718 were filled in with 2'-F modifications, as well as phosphorothioate linkages and tetraloop structures. A total of 96 different tetraloop constructs (eight modification patterns across twelve sequences) were tested in HeLa cells. Conversion of the 2'-O-methyl modification patterns of 25/27mer DsiRNAs to tetraloop-possessing agents was performed in the manner shown in FIG. 8A. As shown in FIGS. 8D to 8E, a number of highly modified tetraloop-possessing constructs were identified as potent in HeLa cell assays and were selected for scale-up synthesis. Thus, multiple sequences with multiple patterns were active as tetraloop constructs. It was noted that M660/M594 and M660/M604 modification patterns were tolerated by most tested sequences. The following constructs were selected for scale-up and in vivo testing: LDHA-355-M650/M595; LDHA-355-M624/M596; LDHA-402-M650/M595; LDHA-718-M660/M604; LDHA-723-M624/M595; LDHA-723-M649/M595; LDHA-892-M660/M594; and LDHA-1360-M624/M595. Dose curve and stability analyses are optionally performed upon such constructs.

Figure 9A:
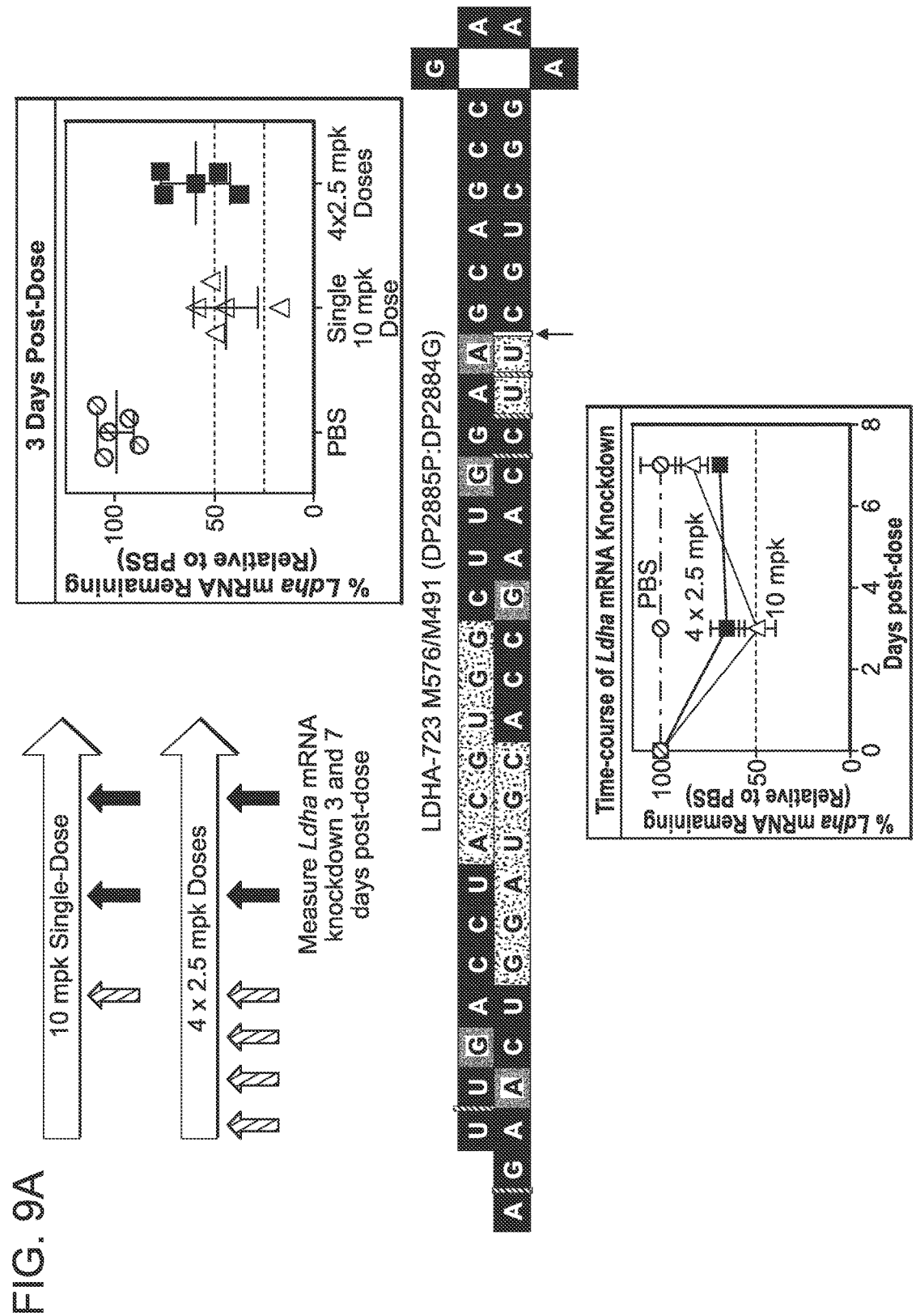
FIGS. 9A to 9C show that GalNAc-conjugated tetraloop-possessing agents of the invention showed dramatic knockdown efficacy in vivo, and that such knockdown efficacy produced reduced urine oxalate levels in treated PH1 model mice.

The LDHA-723 M576/M491 tetraloop construct was also conjugated to GalNAc moieties and tested for in vivo efficacy. As shown in FIG. 9A, this agent was highly effective at knocking down the mouse Ldha gene in liver, under either of the two dosing regimens examined (single dose at 10 mg/kg or 4×2.5 mg/kg dose). In particular, approximately 30% to 60% or greater knockdown of Ldha in liver was observed in all treated animals. Average levels of knockdown for single dose animals exceeded 50% at three days post-administration. Thus, the tetraloop and GalNAc-conjugated form of LDHA-723 M576/M491 was confirmed to be highly active in liver tissue.

Figure 9B:
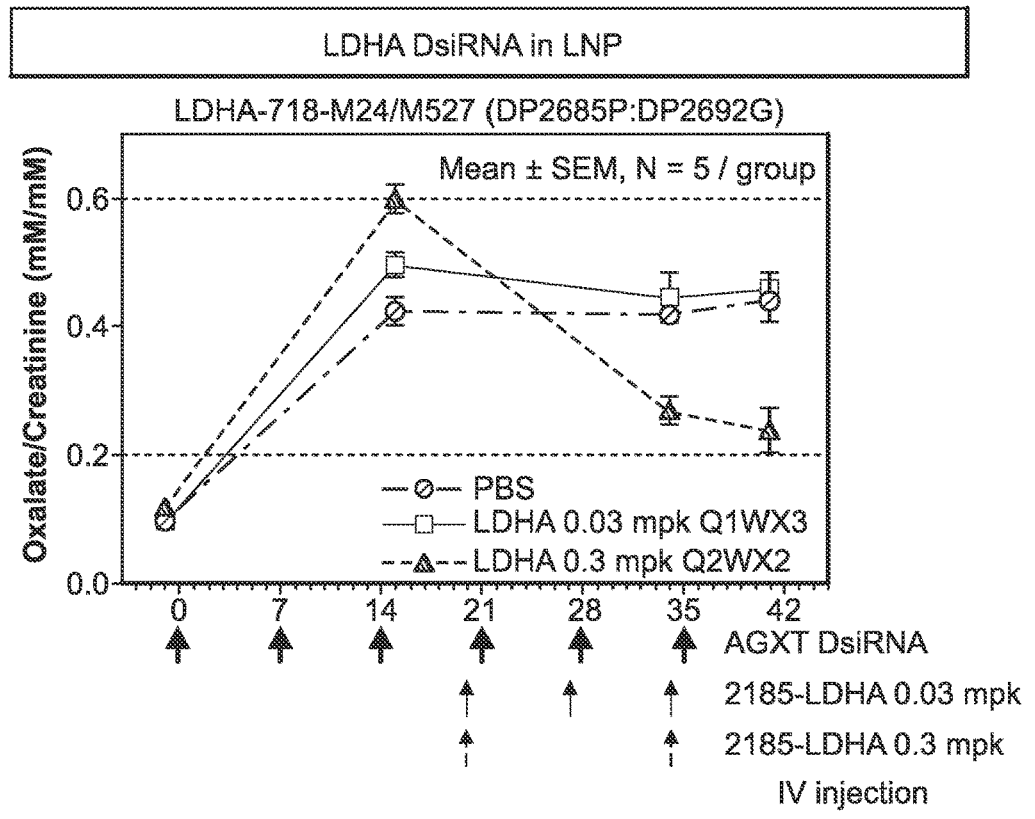
Figure 9B:
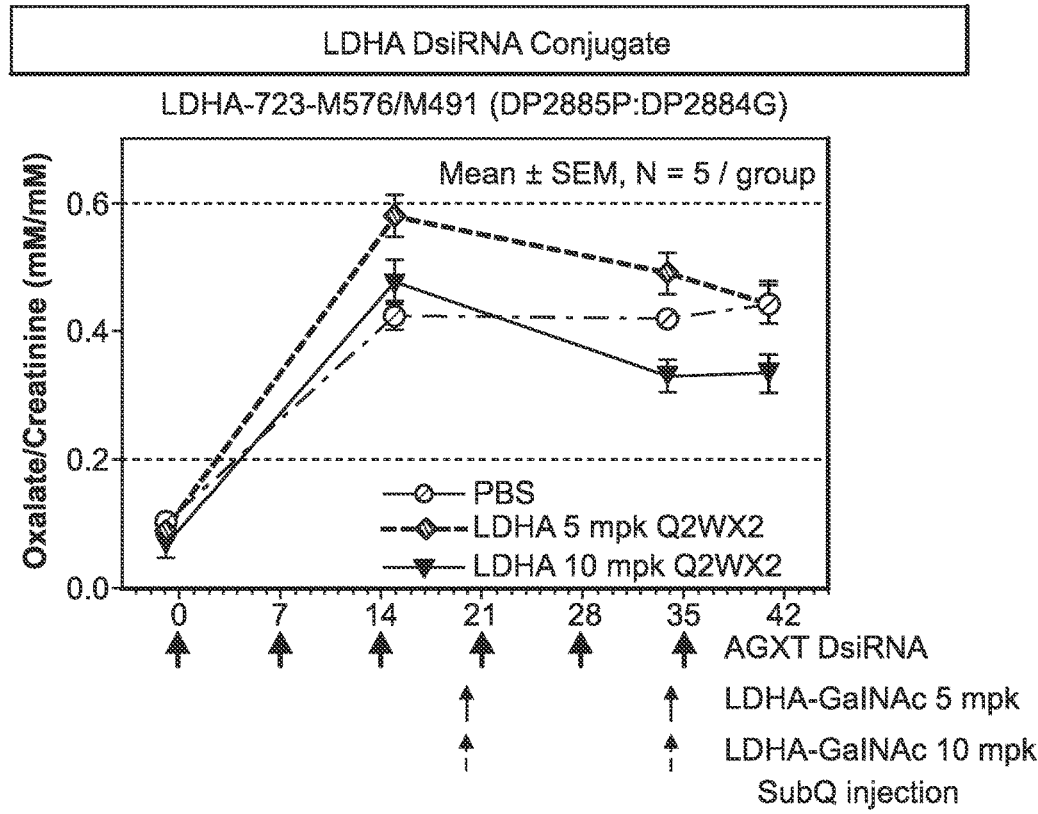

The tetraloop and GalNAc-conjugated form of LDHA-723 M576/M491 was also assessed for impact upon urine oxalate levels in PH1 model mice. In such experiments, C57BL/6 male mice were intravenously injected weekly with Agxt DsiRNA (in LNP 2185 formulation), to induce a PH1 model. Injection of LDHA-targeting DsiRNA constructs was then performed by dosing schedules indicated by arrows in FIG. 9B (with intravenous injection performed for LNP-formulated DsiRNA LDHA-718-M24/M527 (DP2685P:DP2692G), while subcutaneous injection was performed for the tetraloop and GalNAc-conjugated form of LDHA-723 M576/M491). Urine samples were collected manually at the indicated timepoints, and the tetraloop and GalNAc-conjugated form of LDHA-723 M576/M491 at 10 mg/kg was identified to have significantly reduced urine oxalate levels in the PH1 model system mice.

Figure 9C:
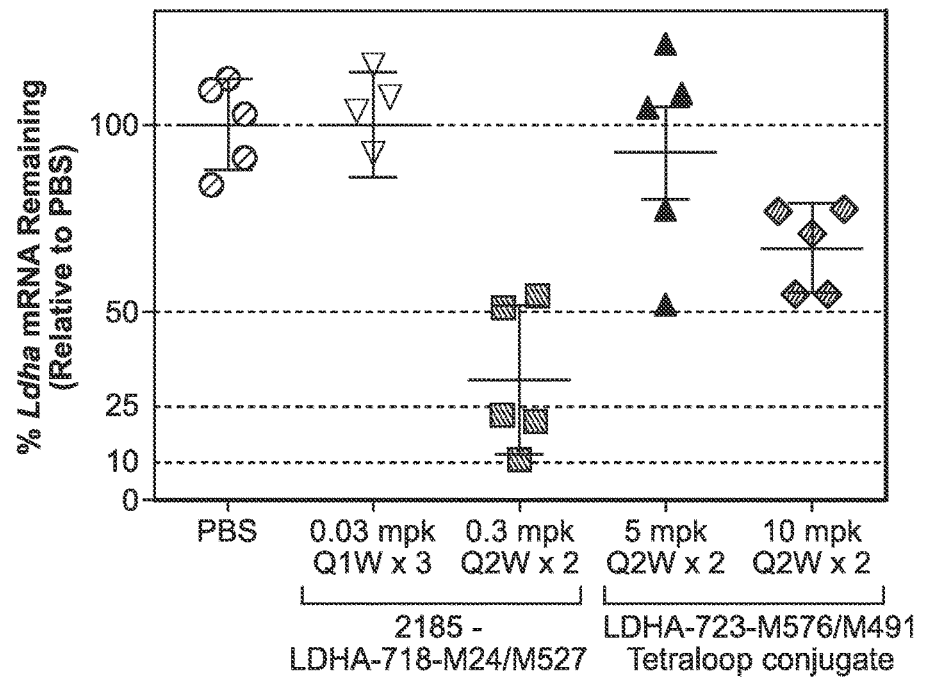
Figure 9C:
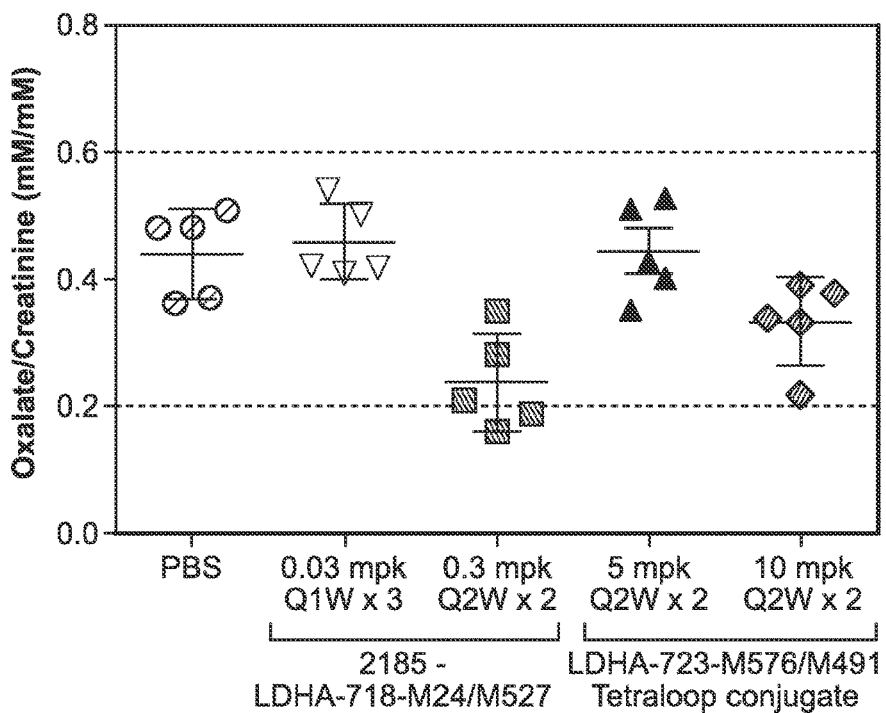

The urine oxalate-reducing efficacy of the tetraloop and GalNAc-conjugated form of LDHA-723 M576/M491 appeared to be dose-dependent, as was further demonstrated in FIG. 9C. Specifically, varying doses of either LNP-formulated LDHA-718 or tetraloop and GalNAc-conjugated form of LDHA-723 M576/M491 were injected intravenously weekly into C57BL/6 male mice that had been pre-treated (and continued to be treated) with Agxt DsiRNA (LNP 2185-formulated), and urine samples were obtained and assessed at seven days after the last dose. Both LNP-formulated LDHA-718 and the tetraloop and GalNAc-conjugated form of LDHA-723 M576/M491 were observed to exhibit a dose-dependent effect on both Ldha mRNA knockdown and reducing urine oxalate levels (FIG. 9C). Additional tetraloop and GalNAc-conjugated forms of LDHA-targeting DsiRNAs were also produced and tested, resulting in identification of certain tetraloop and GalNAc-conjugated forms of LDHA-targeting DsiRNAs possessing single dose $IC_{50}$ values of approximately 3.0 mg/kg (data not shown). Thus, highly active tetraloop and GalNAc-conjugated forms of LDHA-targeting DsiRNAs were identified.

Example 7: LNP-Formulated LDHA-Targeting DsiRNA Knocked Down LDHA Levels in Tumor Cells In Vivo The effect of an LNP-formulated LDHA RNAi agent (specifically, the LDHA-718-M571/M550 25/27mer DsiRNA) in a Hep3B tumor model in nude mice was examined.

LDHA-718-M571/M550 was formulated in EnCore lipid nanoparticles (LNP2540) and tested in Hep3B tumor bearing mice. To generate a tumor model, the nude mice were subcutaneously implanted with 5e6 Hep3B cells and matrigel. When tumors reached an average size of 200 $mm^3$, they were sorted into 3 groups (n=6), such that each group possessed similar average tumor size. These groups were then treated with either PBS, LNP2540/Control DsiRNA or with LNP2540/LDHA DsiRNA every day at 3 mpk for three days. After a four day break, the same treatment schedule was continued for another week. Tumor sizes were measured twice a week to monitor the tumor growth during LDHA treatment. In addition to monitoring tumor sizes, an additional set of mice (n=3) with tumors were also kept in this study to monitor the target knockdown. 24 h after the first round of dosing, the tumors from satellite mice were collected to determine LDHA mRNA knockdown (KD).

Figure 10A:
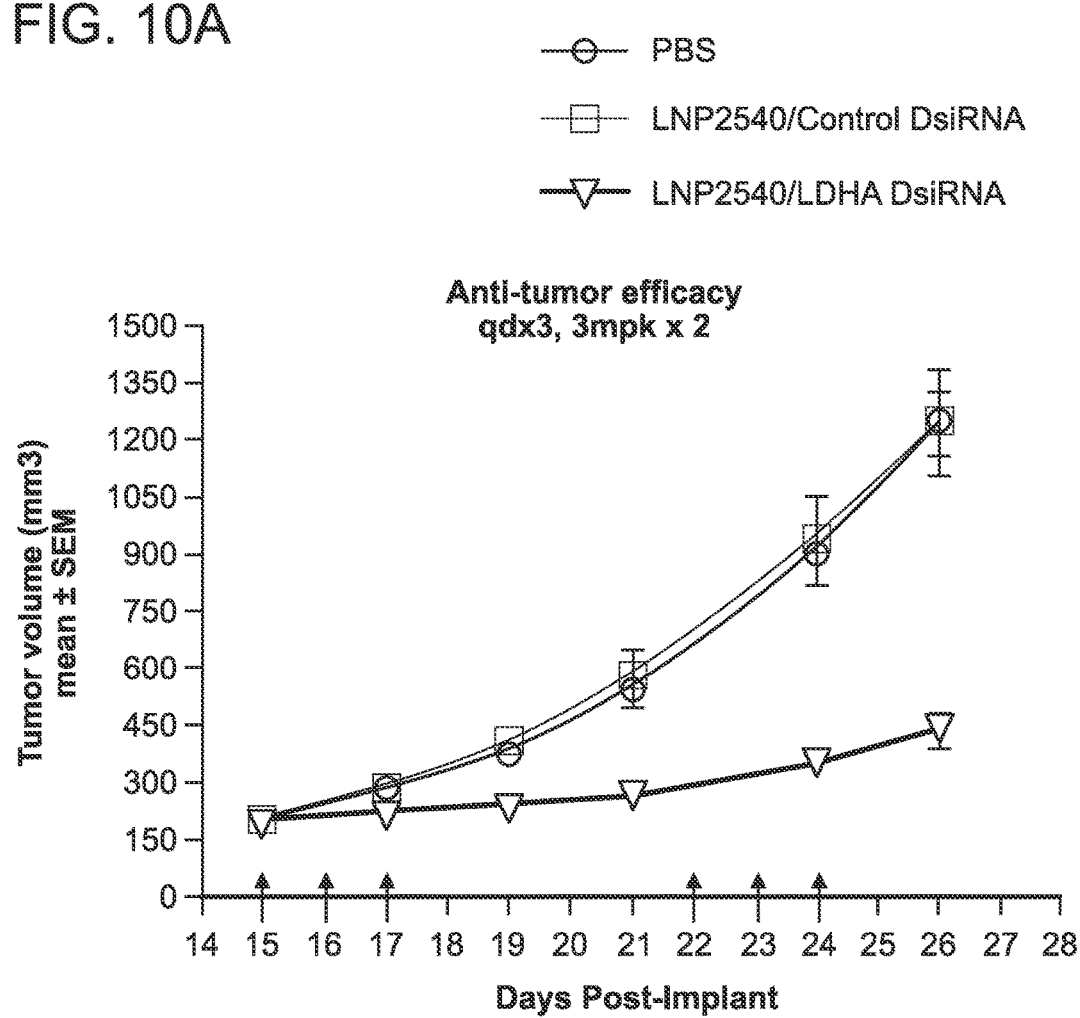

As shown in FIGS. 10A and 10B, LNP2540/LDHA-718-M571/M550 possessed high levels of anti-tumor efficacy (TGI of 78%; FIG. 10A) and also produced >75% knockdown of LDHA in Hep3B tumors of treated animals, on average (FIG. 10B), after a single round of dosing with the LNP/LDHA-718-M571/M550 DsiRNA.

Thus, an LNP-formulated LDHA DsiRNA was identified to be a robust inhibitor of liver tumor in vivo, and was also verified to have produced dramatic knockdown of LDHA in such liver tumor tissues.

Figure 11:
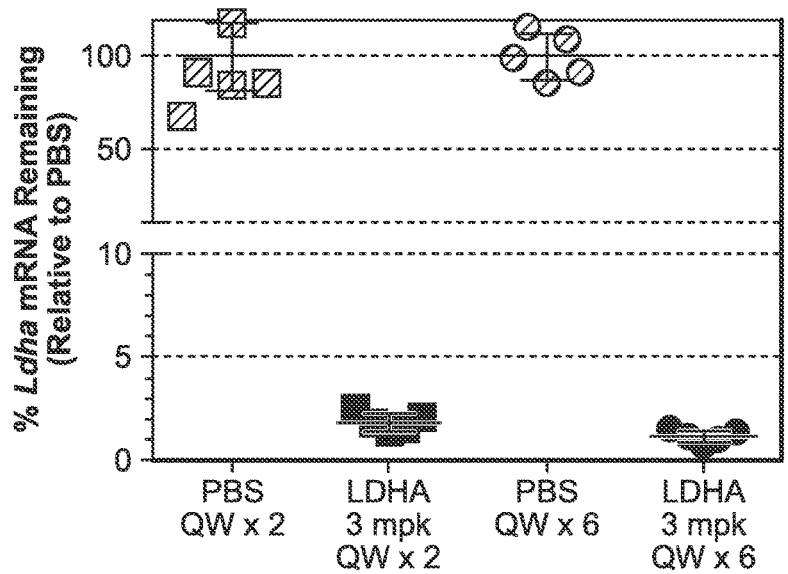
FIG. 11 shows that LNP-formulated LDHA-targeting DsiRNAs were well tolerated in vivo.
Figure 11:
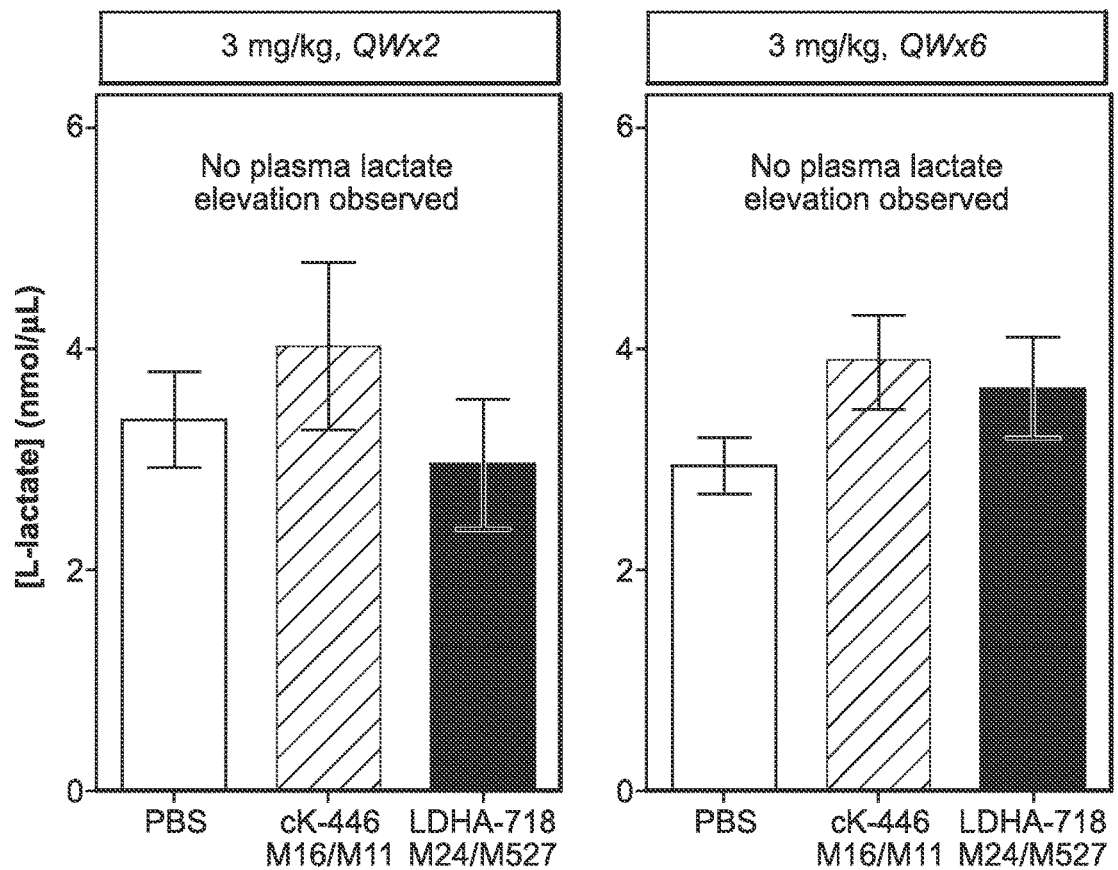

Example 8: Liver-Specific Ldha DsiRNA Knockdown in Wild-Type Mice was Well Tolerated In view of the role of liver LDHA in processing plasma lactate, it was possible that LDHA knockdown in liver would produce a deleterious buildup of plasma lactate levels. To examine whether LNP-formulated LDHA-targeting DsiRNAs exhibited toxicity (e.g., as might be expected if significant knockdown of LDHA in the liver caused plasma lactate to accumulate) wild-type mice were administered the LDHA-718-M24/M527 DsiRNA in LNP 2185, at a concentration of 3 mg/kg, weekly, via intravenous injection. As is shown in FIG. 11, LNP-formulated LDHA-targeting DsiRNAs were observed to have reduced the expression of mRNA in liver tissue to less than 2% of control levels at the end of the study (FIG. 11, at left). Meanwhile, no elevation of plasma lactate levels was observed in treated animals (FIG. 11, at center and right). Moreover, liver enzymes, blood chemistry, body weight and systemic lactic acid were all observed to be normal. Accordingly, LNP-formulated LDHA-targeting DsiRNAs were well tolerated in vivo.

Example 9: DsiRNA Inhibition of LDHA—Secondary Screen

A selection of asymmetric DsiRNAs (e.g., 24 targeting Hs LDHA, a selection of which also target Mm lactate dehydrogenase) of the above experiments (e.g., Examples 2-4) are also examined in a secondary assay ("Phase 2"). Specifically, the asymmetric DsiRNAs selected from those tested above are assessed for inhibition of human lactate dehydrogenase at 1 nM, 0.1 nM and 0.03 nM in the environment of human HeLa cells. These asymmetric DsiRNAs are then also assessed for inhibition of mouse LDHA at 1 nM, 0.1 nM and 0.03 nM in the environment of mouse B16-F10 cells. Most asymmetric DsiRNAs are expected to reproducibly exhibit significant LDHA inhibitory efficacies at sub-nanomolar concentrations when assayed in the environment of HeLa cells. In addition, a select number of asymmetric DsiRNAs are expected to be identified that possess significant mouse lactate dehydrogenase inhibitory efficacies at sub-nanomolar concentrations when assayed in the environment of mouse B16-F10 cells.

Example 10: Identification of Additional Modified Forms of LDHA-Targeting DsiRNAs that Reduce Lactate Dehydrogenase Levels In Vitro A selection (e.g., 12-24) of lactate dehydrogenase-targeting DsiRNAs of the above initial screen are prepared with 2'-O-methyl guide and passenger strand modification patterns as described above; exemplary modifications include "M107" modified passenger strands and above-described guide strand modification patterns "M8", "M17", "M35" and "M48"). For each of the DsiRNA sequences, DsiRNAs possessing each of the four guide strand modification patterns M8, M17, M35 and M48 are assayed for LDHA inhibition in human HeLa cells at 1.0 nM, 0.1 nM and 0.03 nM concentrations in the environment of the HeLa cells. Identification of a modification pattern that allows the DsiRNA to retain significant lactate dehydrogenase inhibitory efficacy in vitro is therefore achieved, with such highly active modified DsiRNA sequences possessing modification patterns believed to be capable of stabilizing such DsiRNAs and/or reducing immunogenicity of such DsiRNAs when therapeutically administered to a subject in vivo.

Example 11: Additional Forms of LDHA-Targeting DsiRNAs Possessing Modifications of Both Guide and Passenger Strands Additional LDHA-Targeting DsiRNAs of the above experiments are prepared with 2'-O-methyl passenger strand and guide strand modification patterns, e.g., as represented above (including, e.g., passenger strand modification patterns "SM14", "SM24", "SM107", "SM250", "SM251" and "SM252" and guide strand modification patterns "M48", "M8" and "M17"). For each of the DsiRNA sequences, DsiRNAs possessing each of the six passenger strand modification patterns M14, M24, M107, M250, M251 and M252 and one preferred guide strand modification pattern (selected from among guide strand modification patterns M48, M8 and M17) are assayed for lactate dehydrogenase inhibition in human HeLa cells at 1.0 nM, 0.1 nM and 0.03 nM (30 picomolar) concentrations in the environment of the HeLa cells. Duplexes possessing extensive modification of both guide and passenger strands are identified that still allow the DsiRNA to retain significant lactate dehydrogenase inhibitory efficacy in vitro. Highly active modified DsiRNA sequences so identified possess modification patterns believed to be capable of stabilizing such DsiRNAs and/or reducing immunogenicity of such DsiRNAs when therapeutically administered to a subject in vivo.

Example 12: Indications

The present body of knowledge in lactate dehydrogenase research indicates the need for methods to assay lactate dehydrogenase activity and for compounds that can regulate lactate dehydrogenase expression for research, diagnostic, and therapeutic use. As described herein, the nucleic acid molecules of the present invention can be used in assays to diagnose and/or monitor a disease state that has the potential to be treated by lactate dehydrogenase-targeting agents. In addition, the nucleic acid molecules can be used to treat such a disease state (e.g., PH1).

Other therapeutic agents can be combined with or used in conjunction with the nucleic acid molecules (e.g. DsiRNA molecules) of the instant invention. For example, for purpose of treating PH1, both anti-LDHA and anti-glycolate oxidase dsRNAs (e.g., DsiRNAs) can be combined to impede oxalate production. Those skilled in the art will recognize that other compounds and therapies used to treat the diseases and conditions described herein can be combined with the nucleic acid molecules of the instant invention (e.g. siNA molecules) and are hence within the scope of the instant invention. For example, for combination therapy, the nucleic acids of the invention can be prepared in one of at least two ways. First, the agents are physically combined in a preparation of nucleic acid and other agent, such as a mixture of a nucleic acid of the invention encapsulated in liposomes and other agent in a solution for intravenous administration, wherein both agents are present in a therapeutically effective concentration (e.g., the other agent in solution to deliver 1000-1250 mg/m2/day and liposome-associated nucleic acid of the invention in the same solution to deliver 0.1-100 mg/kg/day). Alternatively, the agents are administered separately but simultaneously or successively in their respective effective doses (e.g., 1000-1250 mg/m2/d other agent and 0.1 to 100 mg/kg/day nucleic acid of the invention).

Example 13: Serum Stability for DsiRNAs

Serum stability of DsiRNA agents is assessed via incubation of DsiRNA agents in 50% fetal bovine serum for various periods of time (up to 24 h) at 37° C. Serum is extracted and the nucleic acids are separated on a 20% non-denaturing PAGE and can be visualized with Gelstar stain. Relative levels of protection from nuclease degradation are assessed for DsiRNAs (optionally with and without modifications).

Example 14: Liver-Targeted LDHA Knockdown Effects in PH Model Mice

The etiology of chronic kidney stone formation and chronic kidney disease is tested using largely liver-specific LDHA-targeting agents and formulations of the invention. Combined PH1, PH2 and PH3 models (e.g., PH2/PH3, PH1/PH3, PH1/PH2 and/or PH1/PH2/PH3 models) are generated in large groups of mice, causing multiple simultaneous and interacting disruptions of mono- and dicarboxylic acid metabolism. LNP-formulated LDHA-targeting DsiRNAs and controls are tested in these animals, with the expectation that LDHA knockdown will prove beneficial/corrective to each model treated and examined.

Example 15: Diagnostic Uses

The DsiRNA molecules of the invention can be used in a variety of diagnostic applications, such as in the identification of molecular targets (e.g., RNA) in a variety of applications, for example, in clinical, industrial, environmental, agricultural and/or research settings. Such diagnostic use of DsiRNA molecules involves utilizing reconstituted RNAi systems, for example, using cellular lysates or partially purified cellular lysates. DsiRNA molecules of this invention can be used as diagnostic tools to examine genetic drift and mutations within diseased cells. The close relationship between DsiRNA activity and the structure of the target lactate dehydrogenase RNA allows the detection of mutations in a region of the lactate dehydrogenase molecule, which alters the base-pairing and three-dimensional structure of the target lactate dehydrogenase RNA. By using multiple DsiRNA molecules described in this invention, one can map nucleotide changes, which are important to RNA structure and function in vitro, as well as in cells and tissues. Cleavage of target lactate dehydrogenase RNAs with DsiRNA molecules can be used to inhibit gene expression and define the role of specified gene products in the progression of PH1 or other lactate dehydrogenase-associated disease or disorder. In this manner, other genetic targets can be defined as important mediators of the disease. These experiments will lead to better treatment of the disease progression by affording the possibility of combination therapies (e.g., multiple DsiRNA molecules targeted to different genes, DsiRNA molecules coupled with known small molecule inhibitors, or intermittent treatment with combinations of DsiRNA molecules and/or other chemical or biological molecules). Other in vitro uses of DsiRNA molecules of this invention are well known in the art, and include detection of the presence of RNAs associated with a disease or related condition. Such RNA is detected by determining the presence of a cleavage product after treatment with a DsiRNA using standard methodologies, for example, fluorescence resonance emission transfer (FRET).

All patents and publications mentioned in the specification are indicative of the levels of skill of those skilled in the art to which the invention pertains. All references cited in this disclosure are incorporated by reference to the same extent as if each reference had been incorporated by reference in its entirety individually.

One skilled in the art would readily appreciate that the present invention is well adapted to carry out the objects and obtain the ends and advantages mentioned, as well as those inherent therein. The methods and compositions described herein as presently representative of preferred embodiments are exemplary and are not intended as limitations on the scope of the invention. Changes therein and other uses will occur to those skilled in the art, which are encompassed within the spirit of the invention, are defined by the scope of the claims.

It will be readily apparent to one skilled in the art that varying substitutions and modifications can be made to the invention disclosed herein without departing from the scope and spirit of the invention. Thus, such additional embodiments are within the scope of the present invention and the following claims. The present invention teaches one skilled in the art to test various combinations and/or substitutions of chemical modifications described herein toward generating nucleic acid constructs with improved activity for mediating RNAi activity. Such improved activity can comprise improved stability, improved bioavailability, and/or improved activation of cellular responses mediating RNAi. Therefore, the specific embodiments described herein are not limiting and one skilled in the art can readily appreciate that specific combinations of the modifications described herein can be tested without undue experimentation toward identifying DsiRNA molecules with improved RNAi activity.

The invention illustratively described herein suitably can be practiced in the absence of any element or elements, limitation or limitations that are not specifically disclosed herein. Thus, for example, in each instance herein any of the terms "comprising", "consisting essentially of", and "consisting of" may be replaced with either of the other two terms. The terms and expressions which have been employed are used as terms of description and not of limitation, and there is no intention that in the use of such terms and expressions of excluding any equivalents of the features shown and described or portions thereof, but it is recognized that various modifications are possible within the scope of the invention claimed. Thus, it should be understood that although the present invention has been specifically disclosed by preferred embodiments, optional features, modification and variation of the concepts herein disclosed may be resorted to by those skilled in the art, and that such modifications and variations are considered to be within the scope of this invention as defined by the description and the appended claims.

In addition, where features or aspects of the invention are described in terms of Markush groups or other grouping of alternatives, those skilled in the art will recognize that the invention is also thereby described in terms of any individual member or subgroup of members of the Markush group or other group.

The use of the terms "a" and "an" and "the" and similar referents in the context of describing the invention (especially in the context of the following claims) are to be construed to cover both the singular and the plural, unless otherwise indicated herein or clearly contradicted by context. The terms "comprising," "having," "including," and "containing" are to be construed as open-ended terms (i.e., meaning "including, but not limited to,") unless otherwise noted. Recitation of ranges of values herein are merely intended to serve as a shorthand method of referring individually to each separate value falling within the range, unless otherwise indicated herein, and each separate value is incorporated into the specification as if it were individually recited herein. All methods described herein can be performed in any suitable order unless otherwise indicated herein or otherwise clearly contradicted by context. The use of any and all examples, or exemplary language (e.g., "such as") provided herein, is intended merely to better illuminate the invention and does not pose a limitation on the scope of the invention unless otherwise claimed. No language in the specification should be construed as indicating any non-claimed element as essential to the practice of the invention.

Embodiments of this invention are described herein, including the best mode known to the inventors for carrying out the invention. Variations of those embodiments may become apparent to those of ordinary skill in the art upon reading the foregoing description.

The inventors expect skilled artisans to employ such variations as appropriate, and the inventors intend for the invention to be practiced otherwise than as specifically described herein. Accordingly, this invention includes all modifications and equivalents of the subject matter recited in the claims appended hereto as permitted by applicable law. Moreover, any combination of the above-described elements in all possible variations thereof is encompassed by the invention unless otherwise indicated herein or otherwise clearly contradicted by context. Those skilled in the art will recognize, or be able to ascertain using no more than routine experimentation, many equivalents to the specific embodiments of the invention described herein. Such equivalents are intended to be encompassed by the following claims.

SEQUENCE LISTING (7215 sequences)

SEQ ID NO: 1 - DNA, 25 bp, Artificial Sequence
  Synthetic oligonucleotide
agaauaagauuacaguuguuggggt

SEQ ID NO: 2 - DNA, 25 bp, Artificial Sequence
  Synthetic oligonucleotide
gaauaagauuacaguuguuggggtt

SEQ ID NO: 3 - DNA, 25 bp, Artificial Sequence
  Synthetic oligonucleotide
aagauuacaguuguugggguuggtg

SEQ ID NO: 4 - DNA, 25 bp, Artificial Sequence
  Synthetic oligonucleotide
agauuacaguuguugggguuggugc

SEQ ID NO: 5 - DNA, 25 bp, Artificial Sequence
  Synthetic oligonucleotide
gauuacaguuguugggguuggugct

SEQ ID NO: 6 - DNA, 25 bp, Artificial Sequence
  Synthetic oligonucleotide
auuacaguuguugggguuggugctg

SEQ ID NO: 7 - DNA, 25 bp, Artificial Sequence
  Synthetic oligonucleotide
uuacaguuguugggguuggugcugt

SEQ ID NO: 8 - DNA, 25 bp, Artificial Sequence
  Synthetic oligonucleotide
uacaguuguugggguuggugcugtt

SEQ ID NO: 9 - DNA, 25 bp, Artificial Sequence
  Synthetic oligonucleotide
acaguuguugggguuggugcugutg

SEQ ID NO: 10 - DNA, 25 bp, Artificial Sequence
  Synthetic oligonucleotide
caguuguugggguuggugcuguugg

SEQ ID NO: 11 - DNA, 25 bp, Artificial Sequence
  Synthetic oligonucleotide
guuguugggguuggugcuguuggca

SEQ ID NO: 12 - DNA, 25 bp, Artificial Sequence
  Synthetic oligonucleotide
uuguugggguuggugcuguuggcat

SEQ ID NO: 13 - DNA, 25 bp, Artificial Sequence
  Synthetic oligonucleotide
ccugugccaucaguaucuuaaugaa

SEQ ID NO: 14 - DNA, 25 bp, Artificial Sequence
  Synthetic oligonucleotide
cugugccaucaguaucuuaaugaag

SEQ ID NO: 15 - DNA, 25 bp, Artificial Sequence
  Synthetic oligonucleotide
ugugccaucaguaucuuaaugaagg

SEQ ID NO: 16 - DNA, 25 bp, Artificial Sequence
  Synthetic oligonucleotide
gugccaucaguaucuuaaugaagga

SEQ ID NO: 17 - DNA, 25 bp, Artificial Sequence
  Synthetic oligonucleotide
ugccaucaguaucuuaaugaaggac

SEQ ID NO: 18 - DNA, 25 bp, Artificial Sequence
  Synthetic oligonucleotide
gccaucaguaucuuaaugaaggact

SEQ ID NO: 19 - DNA, 25 bp, Artificial Sequence
  Synthetic oligonucleotide
ccaucaguaucuuaaugaaggactt

SEQ ID NO: 20 - DNA, 25 bp, Artificial Sequence
  Synthetic oligonucleotide
caucaguaucuuaaugaaggacutg

SEQ ID NO: 21 - DNA, 25 bp, Artificial Sequence
  Synthetic oligonucleotide
guggauaucuugaccuacguggctt

SEQ ID NO: 22 - DNA, 25 bp, Artificial Sequence
  Synthetic oligonucleotide
gauaucuugaccuacguggcuugga

SEQ ID NO: 23 - DNA, 25 bp, Artificial Sequence
  Synthetic oligonucleotide
auaucuugaccuacguggcuuggaa

SEQ ID NO: 24 - DNA, 25 bp, Artificial Sequence
  Synthetic oligonucleotide
uaucuugaccuacguggcuuggaag

SEQ ID NO: 25 - DNA, 25 bp, Artificial Sequence
  Synthetic oligonucleotide
aucuugaccuacguggcuuggaaga

SEQ ID NO: 26 - DNA, 25 bp, Artificial Sequence
  Synthetic oligonucleotide
cuugaccuacguggcuuggaagata

SEQ ID NO: 27 - DNA, 25 bp, Artificial Sequence
  Synthetic oligonucleotide
uugaccuacguggcuuggaagauaa

SEQ ID NO: 28 - DNA, 25 bp, Artificial Sequence
  Synthetic oligonucleotide
ugaccuacguggcuuggaagauaag

SEQ ID NO: 29 - DNA, 25 bp, Artificial Sequence
  Synthetic oligonucleotide
ggaagauaagugguuuucccaaaaa

SEQ ID NO: 30 - DNA, 25 bp, Artificial Sequence
  Synthetic oligonucleotide
gaagauaagugguuuucccaaaaac

SEQ ID NO: 31 - DNA, 25 bp, Artificial Sequence
  Synthetic oligonucleotide
ccuguauggaguggaaugaaugutg

SEQ ID NO: 32 - DNA, 25 bp, Artificial Sequence
  Synthetic oligonucleotide
cuguauggaguggaaugaauguugc

SEQ ID NO: 33 - DNA, 25 bp, Artificial Sequence
  Synthetic oligonucleotide
ugaauguugcuggugucucucugaa

SEQ ID NO: 34 - DNA, 25 bp, Artificial Sequence
  Synthetic oligonucleotide
ggacugauaaagauaaggaacagtg

SEQ ID NO: 35 - DNA, 25 bp, Artificial Sequence
  Synthetic oligonucleotide
gcaauuuuaaagucuucugauguca

SEQ ID NO: 36 - DNA, 25 bp, Artificial Sequence
  Synthetic oligonucleotide
caauuuuaaagucuucugaugucat

SEQ ID NO: 37 - DNA, 25 bp, Artificial Sequence
  Synthetic oligonucleotide
uuaaagucuucugaugucauaucat

SEQ ID NO: 38 - DNA, 25 bp, Artificial Sequence
  Synthetic oligonucleotide
uaaagucuucugaugucauaucatt

SEQ ID NO: 39 - DNA, 25 bp, Artificial Sequence
  Synthetic oligonucleotide
aaagucuucugaugucauaucautt

SEQ ID NO: 40 - DNA, 25 bp, Artificial Sequence
  Synthetic oligonucleotide
cauguuguccuuuuuaucugauctg

SEQ ID NO: 41 - DNA, 25 bp, Artificial Sequence
  Synthetic oligonucleotide
auguuguccuuuuuaucugaucugt

SEQ ID NO: 42 - DNA, 25 bp, Artificial Sequence
  Synthetic oligonucleotide
uguuguccuuuuuaucugaucugtg

SEQ ID NO: 43 - DNA, 25 bp, Artificial Sequence
  Synthetic oligonucleotide
guuguccuuuuuaucugaucuguga

SEQ ID NO: 44 - DNA, 25 bp, Artificial Sequence
  Synthetic oligonucleotide
uuguccuuuuuaucugaucugugat

SEQ ID NO: 45 - DNA, 25 bp, Artificial Sequence
  Synthetic oligonucleotide
guccuuuuuaucugaucugugauta

SEQ ID NO: 46 - DNA, 25 bp, Artificial Sequence
  Synthetic oligonucleotide
uccuuuuuaucugaucugugauuaa

SEQ ID NO: 47 - DNA, 25 bp, Artificial Sequence
  Synthetic oligonucleotide
ccuuuuuaucugaucugugauuaaa

SEQ ID NO: 48 - DNA, 25 bp, Artificial Sequence
  Synthetic oligonucleotide
cuuuuuaucugaucugugauuaaag

SEQ ID NO: 49 - DNA, 25 bp, Artificial Sequence
  Synthetic oligonucleotide
uuuuaucugaucugugauuaaagca

SEQ ID NO: 50 - DNA, 25 bp, Artificial Sequence
  Synthetic oligonucleotide
uuuaucugaucugugauuaaagcag

SEQ ID NO: 51 - DNA, 25 bp, Artificial Sequence
  Synthetic oligonucleotide
uuaucugaucugugauuaaagcagt

SEQ ID NO: 52 - DNA, 25 bp, Artificial Sequence
  Synthetic oligonucleotide
caguaauauuuuaagauggacuggg

SEQ ID NO: 53 - DNA, 25 bp, Artificial Sequence
  Synthetic oligonucleotide
aacuccugaaguuagaaauaagaat

SEQ ID NO: 54 - DNA, 25 bp, Artificial Sequence
  Synthetic oligonucleotide
acuccugaaguuagaaauaagaatg

SEQ ID NO: 55 - DNA, 25 bp, Artificial Sequence
  Synthetic oligonucleotide
aacugguuagugugaaauaguuctg

SEQ ID NO: 56 - DNA, 25 bp, Artificial Sequence
  Synthetic oligonucleotide
acugguuagugugaaauaguucugc

SEQ ID NO: 57 - DNA, 25 bp, Artificial Sequence
  Synthetic oligonucleotide
cugguuagugugaaauaguucugcc

SEQ ID NO: 58 - DNA, 25 bp, Artificial Sequence
  Synthetic oligonucleotide
gguuagugugaaauaguucugccac

SEQ ID NO: 59 - DNA, 25 bp, Artificial Sequence
  Synthetic oligonucleotide
auccaguguauaaauccaauaucat

SEQ ID NO: 60 - DNA, 25 bp, Artificial Sequence
  Synthetic oligonucleotide
aguguauaaauccaauaucauguct

SEQ ID NO: 61 - DNA, 25 bp, Artificial Sequence
  Synthetic oligonucleotide
cuuauuuugugaacuauaucaguag

SEQ ID NO: 62 - DNA, 25 bp, Artificial Sequence
  Synthetic oligonucleotide
uauaucaguaguguacauuaccata

SEQ ID NO: 63 - DNA, 25 bp, Artificial Sequence
  Synthetic oligonucleotide
aucaguaguguacauuaccauauaa

SEQ ID NO: 64 - DNA, 25 bp, Artificial Sequence
  Synthetic oligonucleotide
ucaguaguguacauuaccauauaat

SEQ ID NO: 65 - DNA, 25 bp, Artificial Sequence
  Synthetic oligonucleotide
caaccaacuauccaaguguuauacc

SEQ ID NO: 66 - DNA, 25 bp, Artificial Sequence
  Synthetic oligonucleotide
aaccaacuauccaaguguuauacca

SEQ ID NO: 67 - DNA, 25 bp, Artificial Sequence
  Synthetic oligonucleotide
accaacuauccaaguguuauaccaa

SEQ ID NO: 68 - DNA, 25 bp, Artificial Sequence
  Synthetic oligonucleotide
ccaacuauccaaguguuauaccaac

SEQ ID NO: 69 - DNA, 25 bp, Artificial Sequence
  Synthetic oligonucleotide
acuauccaaguguuauaccaacuaa

SEQ ID NO: 70 - DNA, 25 bp, Artificial Sequence
  Synthetic oligonucleotide
cuauccaaguguuauaccaacuaaa

SEQ ID NO: 71 - DNA, 25 bp, Artificial Sequence
  Synthetic oligonucleotide
uccaaguguuauaccaacuaaaacc

SEQ ID NO: 72 - DNA, 25 bp, Artificial Sequence
  Synthetic oligonucleotide
ccaaguguuauaccaacuaaaaccc

SEQ ID NO: 73 - RNA, 27 nt, Artificial Sequence
  Synthetic oligonucleotide
accccaacaacuguaaucuuauucugg

SEQ ID NO: 74 - RNA, 27 nt, Artificial Sequence
  Synthetic oligonucleotide
aaccccaacaacuguaaucuuauucug

SEQ ID NO: 75 - RNA, 27 nt, Artificial Sequence
  Synthetic oligonucleotide
caccaaccccaacaacuguaaucuuau

SEQ ID NO: 76 - RNA, 27 nt, Artificial Sequence
  Synthetic oligonucleotide
gcaccaaccccaacaacuguaaucuua

SEQ ID NO: 77 - RNA, 27 nt, Artificial Sequence
  Synthetic oligonucleotide
agcaccaaccccaacaacuguaaucuu

SEQ ID NO: 78 - RNA, 27 nt, Artificial Sequence
  Synthetic oligonucleotide
cagcaccaaccccaacaacuguaaucu

SEQ ID NO: 79 - RNA, 27 nt, Artificial Sequence
  Synthetic oligonucleotide
acagcaccaaccccaacaacuguaauc

SEQ ID NO: 80 - RNA, 27 nt, Artificial Sequence
  Synthetic oligonucleotide
aacagcaccaaccccaacaacuguaau

SEQ ID NO: 81 - RNA, 27 nt, Artificial Sequence
  Synthetic oligonucleotide
caacagcaccaaccccaacaacuguaa

SEQ ID NO: 82 - RNA, 27 nt, Artificial Sequence
  Synthetic oligonucleotide
ccaacagcaccaaccccaacaacugua

SEQ ID NO: 83 - RNA, 27 nt, Artificial Sequence
  Synthetic oligonucleotide
ugccaacagcaccaaccccaacaacug

SEQ ID NO: 84 - RNA, 27 nt, Artificial Sequence
  Synthetic oligonucleotide
augccaacagcaccaaccccaacaacu

SEQ ID NO: 85 - RNA, 27 nt, Artificial Sequence
  Synthetic oligonucleotide
uucauuaagauacugauggcacaggcc

SEQ ID NO: 86 - RNA, 27 nt, Artificial Sequence
  Synthetic oligonucleotide
cuucauuaagauacugauggcacaggc

SEQ ID NO: 87 - RNA, 27 nt, Artificial Sequence
  Synthetic oligonucleotide
ccuucauuaagauacugauggcacagg

SEQ ID NO: 88 - RNA, 27 nt, Artificial Sequence
  Synthetic oligonucleotide
uccuucauuaagauacugauggcacag

SEQ ID NO: 89 - RNA, 27 nt, Artificial Sequence
  Synthetic oligonucleotide
guccuucauuaagauacugauggcaca

SEQ ID NO: 90 - RNA, 27 nt, Artificial Sequence
  Synthetic oligonucleotide
aguccuucauuaagauacugauggcac

SEQ ID NO: 91 - RNA, 27 nt, Artificial Sequence
  Synthetic oligonucleotide
aaguccuucauuaagauacugauggca

SEQ ID NO: 92 - RNA, 27 nt, Artificial Sequence
  Synthetic oligonucleotide
caaguccuucauuaagauacugauggc

SEQ ID NO: 93 - RNA, 27 nt, Artificial Sequence
  Synthetic oligonucleotide
aagccacguaggucaagauauccacug

SEQ ID NO: 94 - RNA, 27 nt, Artificial Sequence
  Synthetic oligonucleotide
uccaagccacguaggucaagauaucca

SEQ ID NO: 95 - RNA, 27 nt, Artificial Sequence
  Synthetic oligonucleotide
uuccaagccacguaggucaagauaucc

SEQ ID NO: 96 - RNA, 27 nt, Artificial Sequence
  Synthetic oligonucleotide
cuuccaagccacguaggucaagauauc

SEQ ID NO: 97 - RNA, 27 nt, Artificial Sequence
  Synthetic oligonucleotide
ucuuccaagccacguaggucaagauau

SEQ ID NO: 98 - RNA, 27 nt, Artificial Sequence
  Synthetic oligonucleotide
uaucuuccaagccacguaggucaagau

SEQ ID NO: 99 - RNA, 27 nt, Artificial Sequence
  Synthetic oligonucleotide
uuaucuuccaagccacguaggucaaga

SEQ ID NO: 100 - RNA, 27 nt, Artificial Sequence
  Synthetic oligonucleotide
cuuaucuuccaagccacguaggucaag

SEQ ID NO: 101 - RNA, 27 nt, Artificial Sequence
  Synthetic oligonucleotide
uuuuugggaaaaccacuuaucuuccaa

SEQ ID NO: 102 - RNA, 27 nt, Artificial Sequence
  Synthetic oligonucleotide
guuuuugggaaaaccacuuaucuucca

SEQ ID NO: 103 - RNA, 27 nt, Artificial Sequence
  Synthetic oligonucleotide
caacauucauuccacuccauacaggca

SEQ ID NO: 104 - RNA, 27 nt, Artificial Sequence
  Synthetic oligonucleotide
gcaacauucauuccacuccauacaggc

SEQ ID NO: 105 - RNA, 27 nt, Artificial Sequence
  Synthetic oligonucleotide
uucagagagacaccagcaacauucauu

SEQ ID NO: 106 - RNA, 27 nt, Artificial Sequence
  Synthetic oligonucleotide
cacuguuccuuaucuuuaucagucccu

SEQ ID NO: 107 - RNA, 27 nt, Artificial Sequence
  Synthetic oligonucleotide
ugacaucagaagacuuuaaaauugcag

SEQ ID NO: 108 - RNA, 27 nt, Artificial Sequence
  Synthetic oligonucleotide
augacaucagaagacuuuaaaauugca

SEQ ID NO: 109 - RNA, 27 nt, Artificial Sequence
  Synthetic oligonucleotide
augauaugacaucagaagacuuuaaaa

SEQ ID NO: 110 - RNA, 27 nt, Artificial Sequence
  Synthetic oligonucleotide
aaugauaugacaucagaagacuuuaaa

SEQ ID NO: 111 - RNA, 27 nt, Artificial Sequence
  Synthetic oligonucleotide
aaaugauaugacaucagaagacuuuaa

SEQ ID NO: 112 - RNA, 27 nt, Artificial Sequence
  Synthetic oligonucleotide
cagaucagauaaaaaggacaacaugca

SEQ ID NO: 113 - RNA, 27 nt, Artificial Sequence
  Synthetic oligonucleotide
acagaucagauaaaaaggacaacaugc

SEQ ID NO: 114 - RNA, 27 nt, Artificial Sequence
  Synthetic oligonucleotide
cacagaucagauaaaaaggacaacaug

SEQ ID NO: 115 - RNA, 27 nt, Artificial Sequence
  Synthetic oligonucleotide
ucacagaucagauaaaaaggacaacau

SEQ ID NO: 116 - RNA, 27 nt, Artificial Sequence
  Synthetic oligonucleotide
aucacagaucagauaaaaaggacaaca

SEQ ID NO: 117 - RNA, 27 nt, Artificial Sequence
  Synthetic oligonucleotide
uaaucacagaucagauaaaaaggacaa

SEQ ID NO: 118 - RNA, 27 nt, Artificial Sequence
  Synthetic oligonucleotide
uuaaucacagaucagauaaaaaggaca

SEQ ID NO: 119 - RNA, 27 nt, Artificial Sequence
  Synthetic oligonucleotide
uuuaaucacagaucagauaaaaaggac

SEQ ID NO: 120 - RNA, 27 nt, Artificial Sequence
  Synthetic oligonucleotide
cuuuaaucacagaucagauaaaaagga

SEQ ID NO: 121 - RNA, 27 nt, Artificial Sequence
  Synthetic oligonucleotide
ugcuuuaaucacagaucagauaaaaag

SEQ ID NO: 122 - RNA, 27 nt, Artificial Sequence
  Synthetic oligonucleotide
cugcuuuaaucacagaucagauaaaaa

SEQ ID NO: 123 - RNA, 27 nt, Artificial Sequence
  Synthetic oligonucleotide
acugcuuuaaucacagaucagauaaaa

SEQ ID NO: 124 - RNA, 27 nt, Artificial Sequence
  Synthetic oligonucleotide
cccaguccaucuuaaaauauuacugcu

SEQ ID NO: 125 - RNA, 27 nt, Artificial Sequence
  Synthetic oligonucleotide
auucuuauuucuaacuucaggaguuga

SEQ ID NO: 126 - RNA, 27 nt, Artificial Sequence
  Synthetic oligonucleotide
cauucuuauuucuaacuucaggaguug

SEQ ID NO: 127 - RNA, 27 nt, Artificial Sequence
  Synthetic oligonucleotide
cagaacuauuucacacuaaccaguuga

SEQ ID NO: 128 - RNA, 27 nt, Artificial Sequence
  Synthetic oligonucleotide
gcagaacuauuucacacuaaccaguug

SEQ ID NO: 129 - RNA, 27 nt, Artificial Sequence
  Synthetic oligonucleotide
ggcagaacuauuucacacuaaccaguu

SEQ ID NO: 130 - RNA, 27 nt, Artificial Sequence
  Synthetic oligonucleotide
guggcagaacuauuucacacuaaccag

SEQ ID NO: 131 - RNA, 27 nt, Artificial Sequence
  Synthetic oligonucleotide
augauauuggauuuauacacuggaucc

SEQ ID NO: 132 - RNA, 27 nt, Artificial Sequence
  Synthetic oligonucleotide
agacaugauauuggauuuauacacugg

SEQ ID NO: 133 - RNA, 27 nt, Artificial Sequence
  Synthetic oligonucleotide
cuacugauauaguucacaaaauaagau

SEQ ID NO: 134 - RNA, 27 nt, Artificial Sequence
  Synthetic oligonucleotide
uaugguaauguacacuacugauauagu

SEQ ID NO: 135 - RNA, 27 nt, Artificial Sequence
  Synthetic oligonucleotide
uuauaugguaauguacacuacugauau

SEQ ID NO: 136 - RNA, 27 nt, Artificial Sequence
  Synthetic oligonucleotide
auuauaugguaauguacacuacugaua

SEQ ID NO: 137 - RNA, 27 nt, Artificial Sequence
  Synthetic oligonucleotide
gguauaacacuuggauaguugguugca

SEQ ID NO: 138 - RNA, 27 nt, Artificial Sequence
  Synthetic oligonucleotide
ugguauaacacuuggauaguugguugc

SEQ ID NO: 139 - RNA, 27 nt, Artificial Sequence
  Synthetic oligonucleotide
uugguauaacacuuggauaguugguug

SEQ ID NO: 140 - RNA, 27 nt, Artificial Sequence
  Synthetic oligonucleotide
guugguauaacacuuggauaguugguu

SEQ ID NO: 141 - RNA, 27 nt, Artificial Sequence
  Synthetic oligonucleotide
uuaguugguauaacacuuggauaguug

SEQ ID NO: 142 - RNA, 27 nt, Artificial Sequence
  Synthetic oligonucleotide
uuuaguugguauaacacuuggauaguu

SEQ ID NO: 143 - RNA, 27 nt, Artificial Sequence
  Synthetic oligonucleotide
gguuuuaguugguauaacacuuggaua

SEQ ID NO: 144 - RNA, 27 nt, Artificial Sequence
  Synthetic oligonucleotide
ggguuuuaguugguauaacacuuggau

SEQ ID NO: 145 - DNA, 27 bp, Artificial Sequence
  Synthetic oligonucleotide
ccagaataagattacagttgttggggt

SEQ ID NO: 146 - DNA, 27 bp, Artificial Sequence
  Synthetic oligonucleotide
cagaataagattacagttgttggggtt

SEQ ID NO: 147 - DNA, 27 bp, Artificial Sequence
  Synthetic oligonucleotide
ataagattacagttgttggggttggtg

SEQ ID NO: 148 - DNA, 27 bp, Artificial Sequence
  Synthetic oligonucleotide
taagattacagttgttggggttggtgc

SEQ ID NO: 149 - DNA, 27 bp, Artificial Sequence
  Synthetic oligonucleotide
aagattacagttgttggggttggtgct

SEQ ID NO: 150 - DNA, 27 bp, Artificial Sequence
  Synthetic oligonucleotide
agattacagttgttggggttggtgctg

SEQ ID NO: 151 - DNA, 27 bp, Artificial Sequence
  Synthetic oligonucleotide
gattacagttgttggggttggtgctgt

SEQ ID NO: 152 - DNA, 27 bp, Artificial Sequence
  Synthetic oligonucleotide
attacagttgttggggttggtgctgtt

SEQ ID NO: 153 - DNA, 27 bp, Artificial Sequence
  Synthetic oligonucleotide
ttacagttgttggggttggtgctgttg

SEQ ID NO: 154 - DNA, 27 bp, Artificial Sequence
  Synthetic oligonucleotide
tacagttgttggggttggtgctgttgg

SEQ ID NO: 155 - DNA, 27 bp, Artificial Sequence
  Synthetic oligonucleotide
cagttgttggggttggtgctgttggca

SEQ ID NO: 156 - DNA, 27 bp, Artificial Sequence
  Synthetic oligonucleotide
agttgttggggttggtgctgttggcat

SEQ ID NO: 157 - DNA, 27 bp, Artificial Sequence
  Synthetic oligonucleotide
ggcctgtgccatcagtatcttaatgaa

SEQ ID NO: 158 - DNA, 27 bp, Artificial Sequence
  Synthetic oligonucleotide
gcctgtgccatcagtatcttaatgaag

SEQ ID NO: 159 - DNA, 27 bp, Artificial Sequence
  Synthetic oligonucleotide
cctgtgccatcagtatcttaatgaagg

SEQ ID NO: 160 - DNA, 27 bp, Artificial Sequence
  Synthetic oligonucleotide
ctgtgccatcagtatcttaatgaagga

SEQ ID NO: 161 - DNA, 27 bp, Artificial Sequence
  Synthetic oligonucleotide
tgtgccatcagtatcttaatgaaggac

SEQ ID NO: 162 - DNA, 27 bp, Artificial Sequence
  Synthetic oligonucleotide
gtgccatcagtatcttaatgaaggact

SEQ ID NO: 163 - DNA, 27 bp, Artificial Sequence
  Synthetic oligonucleotide
tgccatcagtatcttaatgaaggactt

SEQ ID NO: 164 - DNA, 27 bp, Artificial Sequence
  Synthetic oligonucleotide
gccatcagtatcttaatgaaggacttg

SEQ ID NO: 165 - DNA, 27 bp, Artificial Sequence
  Synthetic oligonucleotide
cagtggatatcttgacctacgtggctt

SEQ ID NO: 166 - DNA, 27 bp, Artificial Sequence
  Synthetic oligonucleotide
tggatatcttgacctacgtggcttgga

SEQ ID NO: 167 - DNA, 27 bp, Artificial Sequence
  Synthetic oligonucleotide
ggatatcttgacctacgtggcttggaa

SEQ ID NO: 168 - DNA, 27 bp, Artificial Sequence
  Synthetic oligonucleotide
gatatcttgacctacgtggcttggaag

SEQ ID NO: 169 - DNA, 27 bp, Artificial Sequence
  Synthetic oligonucleotide
atatcttgacctacgtggcttggaaga

SEQ ID NO: 170 - DNA, 27 bp, Artificial Sequence
  Synthetic oligonucleotide
atcttgacctacgtggcttggaagata

SEQ ID NO: 171 - DNA, 27 bp, Artificial Sequence
  Synthetic oligonucleotide
tcttgacctacgtggcttggaagataa

SEQ ID NO: 172 - DNA, 27 bp, Artificial Sequence
  Synthetic oligonucleotide
cttgacctacgtggcttggaagataag

SEQ ID NO: 173 - DNA, 27 bp, Artificial Sequence
  Synthetic oligonucleotide
ttggaagataagtggttttcccaaaaa

SEQ ID NO: 174 - DNA, 27 bp, Artificial Sequence
  Synthetic oligonucleotide
tggaagataagtggttttcccaaaaac

SEQ ID NO: 175 - DNA, 27 bp, Artificial Sequence
  Synthetic oligonucleotide
tgcctgtatggagtggaatgaatgttg

SEQ ID NO: 176 - DNA, 27 bp, Artificial Sequence
  Synthetic oligonucleotide
gcctgtatggagtggaatgaatgttgc

SEQ ID NO: 177 - DNA, 27 bp, Artificial Sequence
  Synthetic oligonucleotide
aatgaatgttgctggtgtctctctgaa

SEQ ID NO: 178 - DNA, 27 bp, Artificial Sequence
  Synthetic oligonucleotide
agggactgataaagataaggaacagtg

SEQ ID NO: 179 - DNA, 27 bp, Artificial Sequence
  Synthetic oligonucleotide
ctgcaattttaaagtcttctgatgtca

SEQ ID NO: 180 - DNA, 27 bp, Artificial Sequence
  Synthetic oligonucleotide
tgcaattttaaagtcttctgatgtcat

SEQ ID NO: 181 - DNA, 27 bp, Artificial Sequence
  Synthetic oligonucleotide
ttttaaagtcttctgatgtcatatcat

SEQ ID NO: 182 - DNA, 27 bp, Artificial Sequence
  Synthetic oligonucleotide
tttaaagtcttctgatgtcatatcatt

SEQ ID NO: 183 - DNA, 27 bp, Artificial Sequence
  Synthetic oligonucleotide
ttaaagtcttctgatgtcatatcattt

SEQ ID NO: 184 - DNA, 27 bp, Artificial Sequence
  Synthetic oligonucleotide
tgcatgttgtcctttttatctgatctg

SEQ ID NO: 185 - DNA, 27 bp, Artificial Sequence
  Synthetic oligonucleotide
gcatgttgtcctttttatctgatctgt

SEQ ID NO: 186 - DNA, 27 bp, Artificial Sequence
  Synthetic oligonucleotide
catgttgtcctttttatctgatctgtg

SEQ ID NO: 187 - DNA, 27 bp, Artificial Sequence
  Synthetic oligonucleotide
atgttgtcctttttatctgatctgtga

SEQ ID NO: 188 - DNA, 27 bp, Artificial Sequence
  Synthetic oligonucleotide
tgttgtcctttttatctgatctgtgat

SEQ ID NO: 189 - DNA, 27 bp, Artificial Sequence
  Synthetic oligonucleotide
ttgtcctttttatctgatctgtgatta

SEQ ID NO: 190 - DNA, 27 bp, Artificial Sequence
  Synthetic oligonucleotide
tgtcctttttatctgatctgtgattaa

SEQ ID NO: 191 - DNA, 27 bp, Artificial Sequence
  Synthetic oligonucleotide
gtcctttttatctgatctgtgattaaa

SEQ ID NO: 192 - DNA, 27 bp, Artificial Sequence
  Synthetic oligonucleotide
tcctttttatctgatctgtgattaaag

SEQ ID NO: 193 - DNA, 27 bp, Artificial Sequence
  Synthetic oligonucleotide
ctttttatctgatctgtgattaaagca

SEQ ID NO: 194 - DNA, 27 bp, Artificial Sequence
  Synthetic oligonucleotide
tttttatctgatctgtgattaaagcag

SEQ ID NO: 195 - DNA, 27 bp, Artificial Sequence
  Synthetic oligonucleotide
ttttatctgatctgtgattaaagcagt

SEQ ID NO: 196 - DNA, 27 bp, Artificial Sequence
  Synthetic oligonucleotide
agcagtaatattttaagatggactggg

SEQ ID NO: 197 - DNA, 27 bp, Artificial Sequence
  Synthetic oligonucleotide
tcaactcctgaagttagaaataagaat

SEQ ID NO: 198 - DNA, 27 bp, Artificial Sequence
  Synthetic oligonucleotide
caactcctgaagttagaaataagaatg

SEQ ID NO: 199 - DNA, 27 bp, Artificial Sequence
  Synthetic oligonucleotide
tcaactggttagtgtgaaatagttctg

SEQ ID NO: 200 - DNA, 27 bp, Artificial Sequence
  Synthetic oligonucleotide
caactggttagtgtgaaatagttctgc

SEQ ID NO: 201 - DNA, 27 bp, Artificial Sequence
  Synthetic oligonucleotide
aactggttagtgtgaaatagttctgcc

SEQ ID NO: 202 - DNA, 27 bp, Artificial Sequence
  Synthetic oligonucleotide
ctggttagtgtgaaatagttctgccac

SEQ ID NO: 203 - DNA, 27 bp, Artificial Sequence
  Synthetic oligonucleotide
ggatccagtgtataaatccaatatcat

SEQ ID NO: 204 - DNA, 27 bp, Artificial Sequence
  Synthetic oligonucleotide
ccagtgtataaatccaatatcatgtct

SEQ ID NO: 205 - DNA, 27 bp, Artificial Sequence
  Synthetic oligonucleotide
atcttattttgtgaactatatcagtag

SEQ ID NO: 206 - DNA, 27 bp, Artificial Sequence
  Synthetic oligonucleotide
actatatcagtagtgtacattaccata

SEQ ID NO: 207 - DNA, 27 bp, Artificial Sequence
  Synthetic oligonucleotide
atatcagtagtgtacattaccatataa

SEQ ID NO: 208 - DNA, 27 bp, Artificial Sequence
  Synthetic oligonucleotide
tatcagtagtgtacattaccatataat

SEQ ID NO: 209 - DNA, 27 bp, Artificial Sequence
  Synthetic oligonucleotide
tgcaaccaactatccaagtgttatacc

SEQ ID NO: 210 - DNA, 27 bp, Artificial Sequence
  Synthetic oligonucleotide
gcaaccaactatccaagtgttatacca

SEQ ID NO: 211 - DNA, 27 bp, Artificial Sequence
  Synthetic oligonucleotide
caaccaactatccaagtgttataccaa

SEQ ID NO: 212 - DNA, 27 bp, Artificial Sequence
  Synthetic oligonucleotide
aaccaactatccaagtgttataccaac

SEQ ID NO: 213 - DNA, 27 bp, Artificial Sequence
  Synthetic oligonucleotide
caactatccaagtgttataccaactaa

SEQ ID NO: 214 - DNA, 27 bp, Artificial Sequence
  Synthetic oligonucleotide
aactatccaagtgttataccaactaaa

SEQ ID NO: 215 - DNA, 27 bp, Artificial Sequence
  Synthetic oligonucleotide
tatccaagtgttataccaactaaaacc

SEQ ID NO: 216 - DNA, 27 bp, Artificial Sequence
  Synthetic oligonucleotide
atccaagtgttataccaactaaaaccc

SEQ ID NO: 217 - RNA, 25 nt, Artificial Sequence
  Synthetic oligonucleotide
agaauaagauuacaguuguuggggu

SEQ ID NO: 218 - RNA, 25 nt, Artificial Sequence
  Synthetic oligonucleotide
gaauaagauuacaguuguugggguu

SEQ ID NO: 219 - RNA, 25 nt, Artificial Sequence
  Synthetic oligonucleotide
aagauuacaguuguugggguuggug

SEQ ID NO: 220 - RNA, 25 nt, Artificial Sequence
  Synthetic oligonucleotide
agauuacaguuguugggguuggugc

SEQ ID NO: 221 - RNA, 25 nt, Artificial Sequence
  Synthetic oligonucleotide
gauuacaguuguugggguuggugcu

SEQ ID NO: 222 - RNA, 25 nt, Artificial Sequence
  Synthetic oligonucleotide
auuacaguuguugggguuggugcug

SEQ ID NO: 223 - RNA, 25 nt, Artificial Sequence
  Synthetic oligonucleotide
uuacaguuguugggguuggugcugu

SEQ ID NO: 224 - RNA, 25 nt, Artificial Sequence
  Synthetic oligonucleotide
uacaguuguugggguuggugcuguu

SEQ ID NO: 225 - RNA, 25 nt, Artificial Sequence
  Synthetic oligonucleotide
acaguuguugggguuggugcuguug

SEQ ID NO: 226 - RNA, 25 nt, Artificial Sequence
  Synthetic oligonucleotide
caguuguugggguuggugcuguugg

SEQ ID NO: 227 - RNA, 25 nt, Artificial Sequence
  Synthetic oligonucleotide
guuguugggguuggugcuguuggca

SEQ ID NO: 228 - RNA, 25 nt, Artificial Sequence
  Synthetic oligonucleotide
uuguugggguuggugcuguuggcau

SEQ ID NO: 229 - RNA, 25 nt, Artificial Sequence
  Synthetic oligonucleotide
ccugugccaucaguaucuuaaugaa

SEQ ID NO: 230 - RNA, 25 nt, Artificial Sequence
  Synthetic oligonucleotide
cugugccaucaguaucuuaaugaag

SEQ ID NO: 231 - RNA, 25 nt, Artificial Sequence
  Synthetic oligonucleotide
ugugccaucaguaucuuaaugaagg

SEQ ID NO: 232 - RNA, 25 nt, Artificial Sequence
  Synthetic oligonucleotide
gugccaucaguaucuuaaugaagga

SEQ ID NO: 233 - RNA, 25 nt, Artificial Sequence
  Synthetic oligonucleotide
ugccaucaguaucuuaaugaaggac

SEQ ID NO: 234 - RNA, 25 nt, Artificial Sequence
  Synthetic oligonucleotide
gccaucaguaucuuaaugaaggacu

SEQ ID NO: 235 - RNA, 25 nt, Artificial Sequence
  Synthetic oligonucleotide
ccaucaguaucuuaaugaaggacuu

SEQ ID NO: 236 - RNA, 25 nt, Artificial Sequence
  Synthetic oligonucleotide
caucaguaucuuaaugaaggacuug

SEQ ID NO: 237 - RNA, 25 nt, Artificial Sequence
  Synthetic oligonucleotide
guggauaucuugaccuacguggcuu

SEQ ID NO: 238 - RNA, 25 nt, Artificial Sequence
  Synthetic oligonucleotide
gauaucuugaccuacguggcuugga

SEQ ID NO: 239 - RNA, 25 nt, Artificial Sequence
  Synthetic oligonucleotide
auaucuugaccuacguggcuuggaa

SEQ ID NO: 240 - RNA, 25 nt, Artificial Sequence
  Synthetic oligonucleotide
uaucuugaccuacguggcuuggaag

SEQ ID NO: 241 - RNA, 25 nt, Artificial Sequence
  Synthetic oligonucleotide
aucuugaccuacguggcuuggaaga

SEQ ID NO: 242 - RNA, 25 nt, Artificial Sequence
  Synthetic oligonucleotide
cuugaccuacguggcuuggaagaua

SEQ ID NO: 243 - RNA, 25 nt, Artificial Sequence
  Synthetic oligonucleotide
uugaccuacguggcuuggaagauaa

SEQ ID NO: 244 - RNA, 25 nt, Artificial Sequence
  Synthetic oligonucleotide
ugaccuacguggcuuggaagauaag

SEQ ID NO: 245 - RNA, 25 nt, Artificial Sequence
  Synthetic oligonucleotide
ggaagauaagugguuuucccaaaaa

SEQ ID NO: 246 - RNA, 25 nt, Artificial Sequence
  Synthetic oligonucleotide
gaagauaagugguuuucccaaaaac

SEQ ID NO: 247 - RNA, 25 nt, Artificial Sequence
  Synthetic oligonucleotide
ccuguauggaguggaaugaauguug

SEQ ID NO: 248 - RNA, 25 nt, Artificial Sequence
  Synthetic oligonucleotide
cuguauggaguggaaugaauguugc

SEQ ID NO: 249 - RNA, 25 nt, Artificial Sequence
  Synthetic oligonucleotide
ugaauguugcuggugucucucugaa

SEQ ID NO: 250 - RNA, 25 nt, Artificial Sequence
  Synthetic oligonucleotide
ggacugauaaagauaaggaacagug

SEQ ID NO: 251 - RNA, 25 nt, Artificial Sequence
  Synthetic oligonucleotide
gcaauuuuaaagucuucugauguca

SEQ ID NO: 252 - RNA, 25 nt, Artificial Sequence
  Synthetic oligonucleotide
caauuuuaaagucuucugaugucau

SEQ ID NO: 253 - RNA, 25 nt, Artificial Sequence
  Synthetic oligonucleotide
uuaaagucuucugaugucauaucau

SEQ ID NO: 254 - RNA, 25 nt, Artificial Sequence
  Synthetic oligonucleotide
uaaagucuucugaugucauaucauu

SEQ ID NO: 255 - RNA, 25 nt, Artificial Sequence
  Synthetic oligonucleotide
aaagucuucugaugucauaucauuu

SEQ ID NO: 256 - RNA, 25 nt, Artificial Sequence
  Synthetic oligonucleotide
cauguuguccuuuuuaucugaucug

SEQ ID NO: 257 - RNA, 25 nt, Artificial Sequence
  Synthetic oligonucleotide
auguuguccuuuuuaucugaucugu

SEQ ID NO: 258 - RNA, 25 nt, Artificial Sequence
  Synthetic oligonucleotide
uguuguccuuuuuaucugaucugug

SEQ ID NO: 259 - RNA, 25 nt, Artificial Sequence
  Synthetic oligonucleotide
guuguccuuuuuaucugaucuguga

SEQ ID NO: 260 - RNA, 25 nt, Artificial Sequence
  Synthetic oligonucleotide
uuguccuuuuuaucugaucugugau

SEQ ID NO: 261 - RNA, 25 nt, Artificial Sequence
  Synthetic oligonucleotide
guccuuuuuaucugaucugugauua

SEQ ID NO: 262 - RNA, 25 nt, Artificial Sequence
  Synthetic oligonucleotide
uccuuuuuaucugaucugugauuaa

SEQ ID NO: 263 - RNA, 25 nt, Artificial Sequence
  Synthetic oligonucleotide
ccuuuuuaucugaucugugauuaaa

SEQ ID NO: 264 - RNA, 25 nt, Artificial Sequence
  Synthetic oligonucleotide
cuuuuuaucugaucugugauuaaag

SEQ ID NO: 265 - RNA, 25 nt, Artificial Sequence
  Synthetic oligonucleotide
uuuuaucugaucugugauuaaagca

SEQ ID NO: 266 - RNA, 25 nt, Artificial Sequence
  Synthetic oligonucleotide
uuuaucugaucugugauuaaagcag

SEQ ID NO: 267 - RNA, 25 nt, Artificial Sequence
  Synthetic oligonucleotide
uuaucugaucugugauuaaagcagu

SEQ ID NO: 268 - RNA, 25 nt, Artificial Sequence
  Synthetic oligonucleotide
caguaauauuuuaagauggacuggg

SEQ ID NO: 269 - RNA, 25 nt, Artificial Sequence
  Synthetic oligonucleotide
aacuccugaaguuagaaauaagaau

SEQ ID NO: 270 - RNA, 25 nt, Artificial Sequence
  Synthetic oligonucleotide
acuccugaaguuagaaauaagaaug

SEQ ID NO: 271 - RNA, 25 nt, Artificial Sequence
  Synthetic oligonucleotide
aacugguuagugugaaauaguucug

SEQ ID NO: 272 - RNA, 25 nt, Artificial Sequence
  Synthetic oligonucleotide
acugguuagugugaaauaguucugc

SEQ ID NO: 273 - RNA, 25 nt, Artificial Sequence
  Synthetic oligonucleotide
cugguuagugugaaauaguucugcc

SEQ ID NO: 274 - RNA, 25 nt, Artificial Sequence
  Synthetic oligonucleotide
gguuagugugaaauaguucugccac

SEQ ID NO: 275 - RNA, 25 nt, Artificial Sequence
  Synthetic oligonucleotide
auccaguguauaaauccaauaucau

SEQ ID NO: 276 - RNA, 25 nt, Artificial Sequence
  Synthetic oligonucleotide
aguguauaaauccaauaucaugucu

SEQ ID NO: 277 - RNA, 25 nt, Artificial Sequence
  Synthetic oligonucleotide
cuuauuuugugaacuauaucaguag

SEQ ID NO: 278 - RNA, 25 nt, Artificial Sequence
  Synthetic oligonucleotide
uauaucaguaguguacauuaccaua

SEQ ID NO: 279 - RNA, 25 nt, Artificial Sequence
  Synthetic oligonucleotide
aucaguaguguacauuaccauauaa

SEQ ID NO: 280 - RNA, 25 nt, Artificial Sequence
  Synthetic oligonucleotide
ucaguaguguacauuaccauauaau

SEQ ID NO: 281 - RNA, 25 nt, Artificial Sequence
  Synthetic oligonucleotide
caaccaacuauccaaguguuauacc

SEQ ID NO: 282 - RNA, 25 nt, Artificial Sequence
  Synthetic oligonucleotide
aaccaacuauccaaguguuauacca

SEQ ID NO: 283 - RNA, 25 nt, Artificial Sequence
  Synthetic oligonucleotide
accaacuauccaaguguuauaccaa

SEQ ID NO: 284 - RNA, 25 nt, Artificial Sequence
  Synthetic oligonucleotide
ccaacuauccaaguguuauaccaac

SEQ ID NO: 285 - RNA, 25 nt, Artificial Sequence
  Synthetic oligonucleotide
acuauccaaguguuauaccaacuaa

SEQ ID NO: 286 - RNA, 25 nt, Artificial Sequence
  Synthetic oligonucleotide
cuauccaaguguuauaccaacuaaa

SEQ ID NO: 287 - RNA, 25 nt, Artificial Sequence
  Synthetic oligonucleotide
uccaaguguuauaccaacuaaaacc

SEQ ID NO: 288 - RNA, 25 nt, Artificial Sequence
  Synthetic oligonucleotide
ccaaguguuauaccaacuaaaaccc

SEQ ID NO: 289 - RNA, 21 nt, Artificial Sequence
  Synthetic oligonucleotide
ccagaauaagauuacaguugu

SEQ ID NO: 290 - RNA, 21 nt, Artificial Sequence
  Synthetic oligonucleotide
cagaauaagauuacaguuguu

SEQ ID NO: 291 - RNA, 21 nt, Artificial Sequence
  Synthetic oligonucleotide
auaagauuacaguuguugggg

SEQ ID NO: 292 - RNA, 21 nt, Artificial Sequence
  Synthetic oligonucleotide
uaagauuacaguuguuggggu

SEQ ID NO: 293 - RNA, 21 nt, Artificial Sequence
  Synthetic oligonucleotide
aagauuacaguuguugggguu

SEQ ID NO: 294 - RNA, 21 nt, Artificial Sequence
  Synthetic oligonucleotide
agauuacaguuguugggguug

SEQ ID NO: 295 - RNA, 21 nt, Artificial Sequence
  Synthetic oligonucleotide
gauuacaguuguugggguugg

SEQ ID NO: 296 - RNA, 21 nt, Artificial Sequence
  Synthetic oligonucleotide
auuacaguuguugggguuggu

SEQ ID NO: 297 - RNA, 21 nt, Artificial Sequence
  Synthetic oligonucleotide
uuacaguuguugggguuggug

SEQ ID NO: 298 - RNA, 21 nt, Artificial Sequence
  Synthetic oligonucleotide
uacaguuguugggguuggugc

SEQ ID NO: 299 - RNA, 21 nt, Artificial Sequence
  Synthetic oligonucleotide
caguuguugggguuggugcug

SEQ ID NO: 300 - RNA, 21 nt, Artificial Sequence
  Synthetic oligonucleotide
aguuguugggguuggugcugu

SEQ ID NO: 301 - RNA, 21 nt, Artificial Sequence
  Synthetic oligonucleotide
ggccugugccaucaguaucuu

SEQ ID NO: 302 - RNA, 21 nt, Artificial Sequence
  Synthetic oligonucleotide
gccugugccaucaguaucuua

SEQ ID NO: 303 - RNA, 21 nt, Artificial Sequence
  Synthetic oligonucleotide
ccugugccaucaguaucuuaa

SEQ ID NO: 304 - RNA, 21 nt, Artificial Sequence
  Synthetic oligonucleotide
cugugccaucaguaucuuaau

SEQ ID NO: 305 - RNA, 21 nt, Artificial Sequence
  Synthetic oligonucleotide
ugugccaucaguaucuuaaug

SEQ ID NO: 306 - RNA, 21 nt, Artificial Sequence
  Synthetic oligonucleotide
gugccaucaguaucuuaauga

SEQ ID NO: 307 - RNA, 21 nt, Artificial Sequence
  Synthetic oligonucleotide
ugccaucaguaucuuaaugaa

SEQ ID NO: 308 - RNA, 21 nt, Artificial Sequence
  Synthetic oligonucleotide
gccaucaguaucuuaaugaag

SEQ ID NO: 309 - RNA, 21 nt, Artificial Sequence
  Synthetic oligonucleotide
caguggauaucuugaccuacg

SEQ ID NO: 310 - RNA, 21 nt, Artificial Sequence
  Synthetic oligonucleotide
uggauaucuugaccuacgugg

SEQ ID NO: 311 - RNA, 21 nt, Artificial Sequence
  Synthetic oligonucleotide
ggauaucuugaccuacguggc

SEQ ID NO: 312 - RNA, 21 nt, Artificial Sequence
  Synthetic oligonucleotide
gauaucuugaccuacguggcu

SEQ ID NO: 313 - RNA, 21 nt, Artificial Sequence
  Synthetic oligonucleotide
auaucuugaccuacguggcuu

SEQ ID NO: 314 - RNA, 21 nt, Artificial Sequence
  Synthetic oligonucleotide
aucuugaccuacguggcuugg

SEQ ID NO: 315 - RNA, 21 nt, Artificial Sequence
  Synthetic oligonucleotide
ucuugaccuacguggcuugga

SEQ ID NO: 316 - RNA, 21 nt, Artificial Sequence
  Synthetic oligonucleotide
cuugaccuacguggcuuggaa

SEQ ID NO: 317 - RNA, 21 nt, Artificial Sequence
  Synthetic oligonucleotide
uuggaagauaagugguuuucc

SEQ ID NO: 318 - RNA, 21 nt, Artificial Sequence
  Synthetic oligonucleotide
uggaagauaagugguuuuccc

SEQ ID NO: 319 - RNA, 21 nt, Artificial Sequence
  Synthetic oligonucleotide
ugccuguauggaguggaauga

SEQ ID NO: 320 - RNA, 21 nt, Artificial Sequence
  Synthetic oligonucleotide
gccuguauggaguggaaugaa

SEQ ID NO: 321 - RNA, 21 nt, Artificial Sequence
  Synthetic oligonucleotide
aaugaauguugcuggugucuc

SEQ ID NO: 322 - RNA, 21 nt, Artificial Sequence
  Synthetic oligonucleotide
agggacugauaaagauaagga

SEQ ID NO: 323 - RNA, 21 nt, Artificial Sequence
  Synthetic oligonucleotide
cugcaauuuuaaagucuucug

SEQ ID NO: 324 - RNA, 21 nt, Artificial Sequence
  Synthetic oligonucleotide
ugcaauuuuaaagucuucuga

SEQ ID NO: 325 - RNA, 21 nt, Artificial Sequence
  Synthetic oligonucleotide
uuuuaaagucuucugauguca

SEQ ID NO: 326 - RNA, 21 nt, Artificial Sequence
  Synthetic oligonucleotide
uuuaaagucuucugaugucau

SEQ ID NO: 327 - RNA, 21 nt, Artificial Sequence
  Synthetic oligonucleotide
uuaaagucuucugaugucaua

SEQ ID NO: 328 - RNA, 21 nt, Artificial Sequence
  Synthetic oligonucleotide
ugcauguuguccuuuuuaucu

SEQ ID NO: 329 - RNA, 21 nt, Artificial Sequence
  Synthetic oligonucleotide
gcauguuguccuuuuuaucug

SEQ ID NO: 330 - RNA, 21 nt, Artificial Sequence
  Synthetic oligonucleotide
cauguuguccuuuuuaucuga

SEQ ID NO: 331 - RNA, 21 nt, Artificial Sequence
  Synthetic oligonucleotide
auguuguccuuuuuaucugau

SEQ ID NO: 332 - RNA, 21 nt, Artificial Sequence
  Synthetic oligonucleotide
uguuguccuuuuuaucugauc

SEQ ID NO: 333 - RNA, 21 nt, Artificial Sequence
  Synthetic oligonucleotide
uuguccuuuuuaucugaucug

SEQ ID NO: 334 - RNA, 21 nt, Artificial Sequence
  Synthetic oligonucleotide
uguccuuuuuaucugaucugu

SEQ ID NO: 335 - RNA, 21 nt, Artificial Sequence
  Synthetic oligonucleotide
guccuuuuuaucugaucugug

SEQ ID NO: 336 - RNA, 21 nt, Artificial Sequence
  Synthetic oligonucleotide
uccuuuuuaucugaucuguga

SEQ ID NO: 337 - RNA, 21 nt, Artificial Sequence
  Synthetic oligonucleotide
cuuuuuaucugaucugugauu

SEQ ID NO: 338 - RNA, 21 nt, Artificial Sequence
  Synthetic oligonucleotide
uuuuuaucugaucugugauua

SEQ ID NO: 339 - RNA, 21 nt, Artificial Sequence
  Synthetic oligonucleotide
uuuuaucugaucugugauuaa

SEQ ID NO: 340 - RNA, 21 nt, Artificial Sequence
  Synthetic oligonucleotide
agcaguaauauuuuaagaugg

SEQ ID NO: 341 - RNA, 21 nt, Artificial Sequence
  Synthetic oligonucleotide
ucaacuccugaaguuagaaau

SEQ ID NO: 342 - RNA, 21 nt, Artificial Sequence
  Synthetic oligonucleotide
caacuccugaaguuagaaaua

SEQ ID NO: 343 - RNA, 21 nt, Artificial Sequence
  Synthetic oligonucleotide
ucaacugguuagugugaaaua

SEQ ID NO: 344 - RNA, 21 nt, Artificial Sequence
  Synthetic oligonucleotide
caacugguuagugugaaauag

SEQ ID NO: 345 - RNA, 21 nt, Artificial Sequence
  Synthetic oligonucleotide
aacugguuagugugaaauagu

SEQ ID NO: 346 - RNA, 21 nt, Artificial Sequence
  Synthetic oligonucleotide
cugguuagugugaaauaguuc

SEQ ID NO: 347 - RNA, 21 nt, Artificial Sequence
  Synthetic oligonucleotide
ggauccaguguauaaauccaa

SEQ ID NO: 348 - RNA, 21 nt, Artificial Sequence
  Synthetic oligonucleotide
ccaguguauaaauccaauauc

SEQ ID NO: 349 - RNA, 21 nt, Artificial Sequence
  Synthetic oligonucleotide
aucuuauuuugugaacuauau

SEQ ID NO: 350 - RNA, 21 nt, Artificial Sequence
  Synthetic oligonucleotide
acuauaucaguaguguacauu

SEQ ID NO: 351 - RNA, 21 nt, Artificial Sequence
  Synthetic oligonucleotide
auaucaguaguguacauuacc

SEQ ID NO: 352 - RNA, 21 nt, Artificial Sequence
  Synthetic oligonucleotide
uaucaguaguguacauuacca

SEQ ID NO: 353 - RNA, 21 nt, Artificial Sequence
  Synthetic oligonucleotide
ugcaaccaacuauccaagugu

SEQ ID NO: 354 - RNA, 21 nt, Artificial Sequence
  Synthetic oligonucleotide
gcaaccaacuauccaaguguu

SEQ ID NO: 355 - RNA, 21 nt, Artificial Sequence
  Synthetic oligonucleotide
caaccaacuauccaaguguua

SEQ ID NO: 356 - RNA, 21 nt, Artificial Sequence
  Synthetic oligonucleotide
aaccaacuauccaaguguuau

SEQ ID NO: 357 - RNA, 21 nt, Artificial Sequence
  Synthetic oligonucleotide
caacuauccaaguguuauacc

SEQ ID NO: 358 - RNA, 21 nt, Artificial Sequence
  Synthetic oligonucleotide
aacuauccaaguguuauacca

SEQ ID NO: 359 - RNA, 21 nt, Artificial Sequence
  Synthetic oligonucleotide
uauccaaguguuauaccaacu

SEQ ID NO: 360 - RNA, 21 nt, Artificial Sequence
  Synthetic oligonucleotide
auccaaguguuauaccaacua

SEQ ID NO: 361 - RNA, 27 nt, Artificial Sequence
  Synthetic oligonucleotide
ccagaauaagauuacaguuguuggggu

SEQ ID NO: 362 - RNA, 27 nt, Artificial Sequence
  Synthetic oligonucleotide
cagaauaagauuacaguuguugggguu

SEQ ID NO: 363 - RNA, 27 nt, Artificial Sequence
  Synthetic oligonucleotide
auaagauuacaguuguugggguuggug

SEQ ID NO: 364 - RNA, 27 nt, Artificial Sequence
  Synthetic oligonucleotide
uaagauuacaguuguugggguuggugc

SEQ ID NO: 365 - RNA, 27 nt, Artificial Sequence
  Synthetic oligonucleotide
aagauuacaguuguugggguuggugcu

SEQ ID NO: 366 - RNA, 27 nt, Artificial Sequence
  Synthetic oligonucleotide
agauuacaguuguugggguuggugcug

SEQ ID NO: 367 - RNA, 27 nt, Artificial Sequence
  Synthetic oligonucleotide
gauuacaguuguugggguuggugcugu

SEQ ID NO: 368 - RNA, 27 nt, Artificial Sequence
  Synthetic oligonucleotide
auuacaguuguugggguuggugcuguu

SEQ ID NO: 369 - RNA, 27 nt, Artificial Sequence
  Synthetic oligonucleotide
uuacaguuguugggguuggugcuguug

SEQ ID NO: 370 - RNA, 27 nt, Artificial Sequence
  Synthetic oligonucleotide
uacaguuguugggguuggugcuguugg

SEQ ID NO: 371 - RNA, 27 nt, Artificial Sequence
  Synthetic oligonucleotide
caguuguugggguuggugcuguuggca

SEQ ID NO: 372 - RNA, 27 nt, Artificial Sequence
  Synthetic oligonucleotide
aguuguugggguuggugcuguuggcau

SEQ ID NO: 373 - RNA, 27 nt, Artificial Sequence
  Synthetic oligonucleotide
ggccugugccaucaguaucuuaaugaa

SEQ ID NO: 374 - RNA, 27 nt, Artificial Sequence
  Synthetic oligonucleotide
gccugugccaucaguaucuuaaugaag

SEQ ID NO: 375 - RNA, 27 nt, Artificial Sequence
  Synthetic oligonucleotide
ccugugccaucaguaucuuaaugaagg

SEQ ID NO: 376 - RNA, 27 nt, Artificial Sequence
  Synthetic oligonucleotide
cugugccaucaguaucuuaaugaagga

SEQ ID NO: 377 - RNA, 27 nt, Artificial Sequence
  Synthetic oligonucleotide
ugugccaucaguaucuuaaugaaggac

SEQ ID NO: 378 - RNA, 27 nt, Artificial Sequence
  Synthetic oligonucleotide
gugccaucaguaucuuaaugaaggacu

SEQ ID NO: 379 - RNA, 27 nt, Artificial Sequence
  Synthetic oligonucleotide
ugccaucaguaucuuaaugaaggacuu

SEQ ID NO: 380 - RNA, 27 nt, Artificial Sequence
  Synthetic oligonucleotide
gccaucaguaucuuaaugaaggacuug

SEQ ID NO: 381 - RNA, 27 nt, Artificial Sequence
  Synthetic oligonucleotide
caguggauaucuugaccuacguggcuu

SEQ ID NO: 382 - RNA, 27 nt, Artificial Sequence
  Synthetic oligonucleotide
uggauaucuugaccuacguggcuugga

SEQ ID NO: 383 - RNA, 27 nt, Artificial Sequence
  Synthetic oligonucleotide
ggauaucuugaccuacguggcuuggaa

SEQ ID NO: 384 - RNA, 27 nt, Artificial Sequence
  Synthetic oligonucleotide
gauaucuugaccuacguggcuuggaag

SEQ ID NO: 385 - RNA, 27 nt, Artificial Sequence
  Synthetic oligonucleotide
auaucuugaccuacguggcuuggaaga

SEQ ID NO: 386 - RNA, 27 nt, Artificial Sequence
  Synthetic oligonucleotide
aucuugaccuacguggcuuggaagaua

SEQ ID NO: 387 - RNA, 27 nt, Artificial Sequence
  Synthetic oligonucleotide
ucuugaccuacguggcuuggaagauaa

SEQ ID NO: 388 - RNA, 27 nt, Artificial Sequence
  Synthetic oligonucleotide
cuugaccuacguggcuuggaagauaag

SEQ ID NO: 389 - RNA, 27 nt, Artificial Sequence
  Synthetic oligonucleotide
uuggaagauaagugguuuucccaaaaa

SEQ ID NO: 390 - RNA, 27 nt, Artificial Sequence
  Synthetic oligonucleotide
uggaagauaagugguuuucccaaaaac

SEQ ID NO: 391 - RNA, 27 nt, Artificial Sequence
  Synthetic oligonucleotide
ugccuguauggaguggaaugaauguug

SEQ ID NO: 392 - RNA, 27 nt, Artificial Sequence
  Synthetic oligonucleotide
gccuguauggaguggaaugaauguugc

SEQ ID NO: 393 - RNA, 27 nt, Artificial Sequence
  Synthetic oligonucleotide
aaugaauguugcuggugucucucugaa

SEQ ID NO: 394 - RNA, 27 nt, Artificial Sequence
  Synthetic oligonucleotide
agggacugauaaagauaaggaacagug

SEQ ID NO: 395 - RNA, 27 nt, Artificial Sequence
  Synthetic oligonucleotide
cugcaauuuuaaagucuucugauguca

SEQ ID NO: 396 - RNA, 27 nt, Artificial Sequence
  Synthetic oligonucleotide
ugcaauuuuaaagucuucugaugucau

SEQ ID NO: 397 - RNA, 27 nt, Artificial Sequence
  Synthetic oligonucleotide
uuuuaaagucuucugaugucauaucau

SEQ ID NO: 398 - RNA, 27 nt, Artificial Sequence
  Synthetic oligonucleotide
uuuaaagucuucugaugucauaucauu

SEQ ID NO: 399 - RNA, 27 nt, Artificial Sequence
  Synthetic oligonucleotide
uuaaagucuucugaugucauaucauuu

SEQ ID NO: 400 - RNA, 27 nt, Artificial Sequence
  Synthetic oligonucleotide
ugcauguuguccuuuuuaucugaucug

SEQ ID NO: 401 - RNA, 27 nt, Artificial Sequence
  Synthetic oligonucleotide
gcauguuguccuuuuuaucugaucugu

SEQ ID NO: 402 - RNA, 27 nt, Artificial Sequence
  Synthetic oligonucleotide
cauguuguccuuuuuaucugaucugug

SEQ ID NO: 403 - RNA, 27 nt, Artificial Sequence
  Synthetic oligonucleotide
auguuguccuuuuuaucugaucuguga

SEQ ID NO: 404 - RNA, 27 nt, Artificial Sequence
  Synthetic oligonucleotide
uguuguccuuuuuaucugaucugugau

SEQ ID NO: 405 - RNA, 27 nt, Artificial Sequence
  Synthetic oligonucleotide
uuguccuuuuuaucugaucugugauua

SEQ ID NO: 406 - RNA, 27 nt, Artificial Sequence
  Synthetic oligonucleotide
uguccuuuuuaucugaucugugauuaa

SEQ ID NO: 407 - RNA, 27 nt, Artificial Sequence
  Synthetic oligonucleotide
guccuuuuuaucugaucugugauuaaa

SEQ ID NO: 408 - RNA, 27 nt, Artificial Sequence
  Synthetic oligonucleotide
uccuuuuuaucugaucugugauuaaag

SEQ ID NO: 409 - RNA, 27 nt, Artificial Sequence
  Synthetic oligonucleotide
cuuuuuaucugaucugugauuaaagca

SEQ ID NO: 410 - RNA, 27 nt, Artificial Sequence
  Synthetic oligonucleotide
uuuuuaucugaucugugauuaaagcag

SEQ ID NO: 411 - RNA, 27 nt, Artificial Sequence
  Synthetic oligonucleotide
uuuuaucugaucugugauuaaagcagu

SEQ ID NO: 412 - RNA, 27 nt, Artificial Sequence
  Synthetic oligonucleotide
agcaguaauauuuuaagauggacuggg

SEQ ID NO: 413 - RNA, 27 nt, Artificial Sequence
  Synthetic oligonucleotide
ucaacuccugaaguuagaaauaagaau

SEQ ID NO: 414 - RNA, 27 nt, Artificial Sequence
  Synthetic oligonucleotide
caacuccugaaguuagaaauaagaaug

SEQ ID NO: 415 - RNA, 27 nt, Artificial Sequence
  Synthetic oligonucleotide
ucaacugguuagugugaaauaguucug

SEQ ID NO: 416 - RNA, 27 nt, Artificial Sequence
  Synthetic oligonucleotide
caacugguuagugugaaauaguucugc

SEQ ID NO: 417 - RNA, 27 nt, Artificial Sequence
  Synthetic oligonucleotide
aacugguuagugugaaauaguucugcc

SEQ ID NO: 418 - RNA, 27 nt, Artificial Sequence
  Synthetic oligonucleotide
cugguuagugugaaauaguucugccac

SEQ ID NO: 419 - RNA, 27 nt, Artificial Sequence
  Synthetic oligonucleotide
ggauccaguguauaaauccaauaucau

SEQ ID NO: 420 - RNA, 27 nt, Artificial Sequence
  Synthetic oligonucleotide
ccaguguauaaauccaauaucaugucu

SEQ ID NO: 421 - RNA, 27 nt, Artificial Sequence
  Synthetic oligonucleotide
aucuuauuuugugaacuauaucaguag

SEQ ID NO: 422 - RNA, 27 nt, Artificial Sequence
  Synthetic oligonucleotide
acuauaucaguaguguacauuaccaua

SEQ ID NO: 423 - RNA, 27 nt, Artificial Sequence
  Synthetic oligonucleotide
auaucaguaguguacauuaccauauaa

SEQ ID NO: 424 - RNA, 27 nt, Artificial Sequence
  Synthetic oligonucleotide
uaucaguaguguacauuaccauauaau

SEQ ID NO: 425 - RNA, 27 nt, Artificial Sequence
  Synthetic oligonucleotide
ugcaaccaacuauccaaguguuauacc

SEQ ID NO: 426 - RNA, 27 nt, Artificial Sequence
  Synthetic oligonucleotide
gcaaccaacuauccaaguguuauacca

SEQ ID NO: 427 - RNA, 27 nt, Artificial Sequence
  Synthetic oligonucleotide
caaccaacuauccaaguguuauaccaa

SEQ ID NO: 428 - RNA, 27 nt, Artificial Sequence
  Synthetic oligonucleotide
aaccaacuauccaaguguuauaccaac

SEQ ID NO: 429 - RNA, 27 nt, Artificial Sequence
  Synthetic oligonucleotide
caacuauccaaguguuauaccaacuaa

SEQ ID NO: 430 - RNA, 27 nt, Artificial Sequence
  Synthetic oligonucleotide
aacuauccaaguguuauaccaacuaaa

SEQ ID NO: 431 - RNA, 27 nt, Artificial Sequence
  Synthetic oligonucleotide
uauccaaguguuauaccaacuaaaacc

SEQ ID NO: 432 - RNA, 27 nt, Artificial Sequence
  Synthetic oligonucleotide
auccaaguguuauaccaacuaaaaccc

SEQ ID NO: 433 - RNA, 19 nt, Artificial Sequence
  Synthetic oligonucleotide
agaauaagauuacaguugu

SEQ ID NO: 434 - RNA, 19 nt, Artificial Sequence
  Synthetic oligonucleotide
gaauaagauuacaguuguu

SEQ ID NO: 435 - RNA, 19 nt, Artificial Sequence
  Synthetic oligonucleotide
aagauuacaguuguugggg

SEQ ID NO: 436 - RNA, 19 nt, Artificial Sequence
  Synthetic oligonucleotide
agauuacaguuguuggggu

SEQ ID NO: 437 - RNA, 19 nt, Artificial Sequence
  Synthetic oligonucleotide
gauuacaguuguugggguu

SEQ ID NO: 438 - RNA, 19 nt, Artificial Sequence
  Synthetic oligonucleotide
auuacaguuguugggguug

SEQ ID NO: 439 - RNA, 19 nt, Artificial Sequence
  Synthetic oligonucleotide
uuacaguuguugggguugg

SEQ ID NO: 440 - RNA, 19 nt, Artificial Sequence
  Synthetic oligonucleotide
uacaguuguugggguuggu

SEQ ID NO: 441 - RNA, 19 nt, Artificial Sequence
  Synthetic oligonucleotide
acaguuguugggguuggug

SEQ ID NO: 442 - RNA, 19 nt, Artificial Sequence
  Synthetic oligonucleotide
caguuguugggguuggugc

SEQ ID NO: 443 - RNA, 19 nt, Artificial Sequence
  Synthetic oligonucleotide
guuguugggguuggugcug

SEQ ID NO: 444 - RNA, 19 nt, Artificial Sequence
  Synthetic oligonucleotide
uuguugggguuggugcugu

SEQ ID NO: 445 - RNA, 19 nt, Artificial Sequence
  Synthetic oligonucleotide
ccugugccaucaguaucuu

SEQ ID NO: 446 - RNA, 19 nt, Artificial Sequence
  Synthetic oligonucleotide
cugugccaucaguaucuua

SEQ ID NO: 447 - RNA, 19 nt, Artificial Sequence
  Synthetic oligonucleotide
ugugccaucaguaucuuaa

SEQ ID NO: 448 - RNA, 19 nt, Artificial Sequence
  Synthetic oligonucleotide
gugccaucaguaucuuaau

SEQ ID NO: 449 - RNA, 19 nt, Artificial Sequence
  Synthetic oligonucleotide
ugccaucaguaucuuaaug

SEQ ID NO: 450 - RNA, 19 nt, Artificial Sequence
  Synthetic oligonucleotide
gccaucaguaucuuaauga

SEQ ID NO: 451 - RNA, 19 nt, Artificial Sequence
  Synthetic oligonucleotide
ccaucaguaucuuaaugaa

SEQ ID NO: 452 - RNA, 19 nt, Artificial Sequence
  Synthetic oligonucleotide
caucaguaucuuaaugaag

SEQ ID NO: 453 - RNA, 19 nt, Artificial Sequence
  Synthetic oligonucleotide
guggauaucuugaccuacg

SEQ ID NO: 454 - RNA, 19 nt, Artificial Sequence
  Synthetic oligonucleotide
gauaucuugaccuacgugg

SEQ ID NO: 455 - RNA, 19 nt, Artificial Sequence
  Synthetic oligonucleotide
auaucuugaccuacguggc

SEQ ID NO: 456 - RNA, 19 nt, Artificial Sequence
  Synthetic oligonucleotide
uaucuugaccuacguggcu

SEQ ID NO: 457 - RNA, 19 nt, Artificial Sequence
  Synthetic oligonucleotide
aucuugaccuacguggcuu

SEQ ID NO: 458 - RNA, 19 nt, Artificial Sequence
  Synthetic oligonucleotide
cuugaccuacguggcuugg

SEQ ID NO: 459 - RNA, 19 nt, Artificial Sequence
  Synthetic oligonucleotide
uugaccuacguggcuugga

SEQ ID NO: 460 - RNA, 19 nt, Artificial Sequence
  Synthetic oligonucleotide
ugaccuacguggcuuggaa

SEQ ID NO: 461 - RNA, 19 nt, Artificial Sequence
  Synthetic oligonucleotide
ggaagauaagugguuuucc

SEQ ID NO: 462 - RNA, 19 nt, Artificial Sequence
  Synthetic oligonucleotide
gaagauaagugguuuuccc

SEQ ID NO: 463 - RNA, 19 nt, Artificial Sequence
  Synthetic oligonucleotide
ccuguauggaguggaauga

SEQ ID NO: 464 - RNA, 19 nt, Artificial Sequence
  Synthetic oligonucleotide
cuguauggaguggaaugaa

SEQ ID NO: 465 - RNA, 19 nt, Artificial Sequence
  Synthetic oligonucleotide
ugaauguugcuggugucuc

SEQ ID NO: 466 - RNA, 19 nt, Artificial Sequence
  Synthetic oligonucleotide
ggacugauaaagauaagga

SEQ ID NO: 467 - RNA, 19 nt, Artificial Sequence
  Synthetic oligonucleotide
gcaauuuuaaagucuucug

SEQ ID NO: 468 - RNA, 19 nt, Artificial Sequence
  Synthetic oligonucleotide
caauuuuaaagucuucuga

SEQ ID NO: 469 - RNA, 19 nt, Artificial Sequence
  Synthetic oligonucleotide
uuaaagucuucugauguca

SEQ ID NO: 470 - RNA, 19 nt, Artificial Sequence
  Synthetic oligonucleotide
uaaagucuucugaugucau

SEQ ID NO: 471 - RNA, 19 nt, Artificial Sequence
  Synthetic oligonucleotide
aaagucuucugaugucaua

SEQ ID NO: 472 - RNA, 19 nt, Artificial Sequence
  Synthetic oligonucleotide
cauguuguccuuuuuaucu

SEQ ID NO: 473 - RNA, 19 nt, Artificial Sequence
  Synthetic oligonucleotide
auguuguccuuuuuaucug

SEQ ID NO: 474 - RNA, 19 nt, Artificial Sequence
  Synthetic oligonucleotide
uguuguccuuuuuaucuga

SEQ ID NO: 475 - RNA, 19 nt, Artificial Sequence
  Synthetic oligonucleotide
guuguccuuuuuaucugau

SEQ ID NO: 476 - RNA, 19 nt, Artificial Sequence
  Synthetic oligonucleotide
uuguccuuuuuaucugauc

SEQ ID NO: 477 - RNA, 19 nt, Artificial Sequence
  Synthetic oligonucleotide
guccuuuuuaucugaucug

SEQ ID NO: 478 - RNA, 19 nt, Artificial Sequence
  Synthetic oligonucleotide
uccuuuuuaucugaucugu

SEQ ID NO: 479 - RNA, 19 nt, Artificial Sequence
  Synthetic oligonucleotide
ccuuuuuaucugaucugug

SEQ ID NO: 480 - RNA, 19 nt, Artificial Sequence
  Synthetic oligonucleotide
cuuuuuaucugaucuguga

SEQ ID NO: 481 - RNA, 19 nt, Artificial Sequence
  Synthetic oligonucleotide
uuuuaucugaucugugauu

SEQ ID NO: 482 - RNA, 19 nt, Artificial Sequence
  Synthetic oligonucleotide
uuuaucugaucugugauua

SEQ ID NO: 483 - RNA, 19 nt, Artificial Sequence
  Synthetic oligonucleotide
uuaucugaucugugauuaa

SEQ ID NO: 484 - RNA, 19 nt, Artificial Sequence
  Synthetic oligonucleotide
caguaauauuuuaagaugg

SEQ ID NO: 485 - RNA, 19 nt, Artificial Sequence
  Synthetic oligonucleotide
aacuccugaaguuagaaau

SEQ ID NO: 486 - RNA, 19 nt, Artificial Sequence
  Synthetic oligonucleotide
acuccugaaguuagaaaua

SEQ ID NO: 487 - RNA, 19 nt, Artificial Sequence
  Synthetic oligonucleotide
aacugguuagugugaaaua

SEQ ID NO: 488 - RNA, 19 nt, Artificial Sequence
  Synthetic oligonucleotide
acugguuagugugaaauag

SEQ ID NO: 489 - RNA, 19 nt, Artificial Sequence
  Synthetic oligonucleotide
cugguuagugugaaauagu

SEQ ID NO: 490 - RNA, 19 nt, Artificial Sequence
  Synthetic oligonucleotide
gguuagugugaaauaguuc

SEQ ID NO: 491 - RNA, 19 nt, Artificial Sequence
  Synthetic oligonucleotide
auccaguguauaaauccaa

SEQ ID NO: 492 - RNA, 19 nt, Artificial Sequence
  Synthetic oligonucleotide
aguguauaaauccaauauc

SEQ ID NO: 493 - RNA, 19 nt, Artificial Sequence
  Synthetic oligonucleotide
cuuauuuugugaacuauau

SEQ ID NO: 494 - RNA, 19 nt, Artificial Sequence
  Synthetic oligonucleotide
uauaucaguaguguacauu

SEQ ID NO: 495 - RNA, 19 nt, Artificial Sequence
  Synthetic oligonucleotide
aucaguaguguacauuacc

SEQ ID NO: 496 - RNA, 19 nt, Artificial Sequence
  Synthetic oligonucleotide
ucaguaguguacauuacca

SEQ ID NO: 497 - RNA, 19 nt, Artificial Sequence
  Synthetic oligonucleotide
caaccaacuauccaagugu

SEQ ID NO: 498 - RNA, 19 nt, Artificial Sequence
  Synthetic oligonucleotide
aaccaacuauccaaguguu

SEQ ID NO: 499 - RNA, 19 nt, Artificial Sequence
  Synthetic oligonucleotide
accaacuauccaaguguua

SEQ ID NO: 500 - RNA, 19 nt, Artificial Sequence
  Synthetic oligonucleotide
ccaacuauccaaguguuau

SEQ ID NO: 501 - RNA, 19 nt, Artificial Sequence
  Synthetic oligonucleotide
acuauccaaguguuauacc

SEQ ID NO: 502 - RNA, 19 nt, Artificial Sequence
  Synthetic oligonucleotide
cuauccaaguguuauacca

SEQ ID NO: 503 - RNA, 19 nt, Artificial Sequence
  Synthetic oligonucleotide
uccaaguguuauaccaacu

SEQ ID NO: 504 - RNA, 19 nt, Artificial Sequence
  Synthetic oligonucleotide
ccaaguguuauaccaacua

SEQ ID NO: 505 - RNA, 19 nt, Artificial Sequence
  Synthetic oligonucleotide
cagaauaagauuacaguug

SEQ ID NO: 506 - RNA, 19 nt, Artificial Sequence
  Synthetic oligonucleotide
agaauaagauuacaguugu

SEQ ID NO: 507 - RNA, 19 nt, Artificial Sequence
  Synthetic oligonucleotide
uaagauuacaguuguuggg

SEQ ID NO: 508 - RNA, 19 nt, Artificial Sequence
  Synthetic oligonucleotide
aagauuacaguuguugggg

SEQ ID NO: 509 - RNA, 19 nt, Artificial Sequence
  Synthetic oligonucleotide
agauuacaguuguuggggu

SEQ ID NO: 510 - RNA, 19 nt, Artificial Sequence
  Synthetic oligonucleotide
gauuacaguuguugggguu

SEQ ID NO: 511 - RNA, 19 nt, Artificial Sequence
  Synthetic oligonucleotide
auuacaguuguugggguug

SEQ ID NO: 512 - RNA, 19 nt, Artificial Sequence
  Synthetic oligonucleotide
uuacaguuguugggguugg

SEQ ID NO: 513 - RNA, 19 nt, Artificial Sequence
  Synthetic oligonucleotide
uacaguuguugggguuggu

SEQ ID NO: 514 - RNA, 19 nt, Artificial Sequence
  Synthetic oligonucleotide
acaguuguugggguuggug

SEQ ID NO: 515 - RNA, 19 nt, Artificial Sequence
  Synthetic oligonucleotide
aguuguugggguuggugcu

SEQ ID NO: 516 - RNA, 19 nt, Artificial Sequence
  Synthetic oligonucleotide
guuguugggguuggugcug

SEQ ID NO: 517 - RNA, 19 nt, Artificial Sequence
  Synthetic oligonucleotide
gccugugccaucaguaucu

SEQ ID NO: 518 - RNA, 19 nt, Artificial Sequence
  Synthetic oligonucleotide
ccugugccaucaguaucuu

SEQ ID NO: 519 - RNA, 19 nt, Artificial Sequence
  Synthetic oligonucleotide
cugugccaucaguaucuua

SEQ ID NO: 520 - RNA, 19 nt, Artificial Sequence
  Synthetic oligonucleotide
ugugccaucaguaucuuaa

SEQ ID NO: 521 - RNA, 19 nt, Artificial Sequence
  Synthetic oligonucleotide
gugccaucaguaucuuaau

SEQ ID NO: 522 - RNA, 19 nt, Artificial Sequence
  Synthetic oligonucleotide
ugccaucaguaucuuaaug

SEQ ID NO: 523 - RNA, 19 nt, Artificial Sequence
  Synthetic oligonucleotide
gccaucaguaucuuaauga

SEQ ID NO: 524 - RNA, 19 nt, Artificial Sequence
  Synthetic oligonucleotide
ccaucaguaucuuaaugaa

SEQ ID NO: 525 - RNA, 19 nt, Artificial Sequence
  Synthetic oligonucleotide
aguggauaucuugaccuac

SEQ ID NO: 526 - RNA, 19 nt, Artificial Sequence
  Synthetic oligonucleotide
ggauaucuugaccuacgug

SEQ ID NO: 527 - RNA, 19 nt, Artificial Sequence
  Synthetic oligonucleotide
gauaucuugaccuacgugg

SEQ ID NO: 528 - RNA, 19 nt, Artificial Sequence
  Synthetic oligonucleotide
auaucuugaccuacguggc

SEQ ID NO: 529 - RNA, 19 nt, Artificial Sequence
  Synthetic oligonucleotide
uaucuugaccuacguggcu

SEQ ID NO: 530 - RNA, 19 nt, Artificial Sequence
  Synthetic oligonucleotide
ucuugaccuacguggcuug

SEQ ID NO: 531 - RNA, 19 nt, Artificial Sequence
  Synthetic oligonucleotide
cuugaccuacguggcuugg

SEQ ID NO: 532 - RNA, 19 nt, Artificial Sequence
  Synthetic oligonucleotide
uugaccuacguggcuugga

SEQ ID NO: 533 - RNA, 19 nt, Artificial Sequence
  Synthetic oligonucleotide
uggaagauaagugguuuuc

SEQ ID NO: 534 - RNA, 19 nt, Artificial Sequence
  Synthetic oligonucleotide
ggaagauaagugguuuucc

SEQ ID NO: 535 - RNA, 19 nt, Artificial Sequence
  Synthetic oligonucleotide
gccuguauggaguggaaug

SEQ ID NO: 536 - RNA, 19 nt, Artificial Sequence
  Synthetic oligonucleotide
ccuguauggaguggaauga

SEQ ID NO: 537 - RNA, 19 nt, Artificial Sequence
  Synthetic oligonucleotide
augaauguugcuggugucu

SEQ ID NO: 538 - RNA, 19 nt, Artificial Sequence
  Synthetic oligonucleotide
gggacugauaaagauaagg

SEQ ID NO: 539 - RNA, 19 nt, Artificial Sequence
  Synthetic oligonucleotide
ugcaauuuuaaagucuucu

SEQ ID NO: 540 - RNA, 19 nt, Artificial Sequence
  Synthetic oligonucleotide
gcaauuuuaaagucuucug

SEQ ID NO: 541 - RNA, 19 nt, Artificial Sequence
  Synthetic oligonucleotide
uuuaaagucuucugauguc

SEQ ID NO: 542 - RNA, 19 nt, Artificial Sequence
  Synthetic oligonucleotide
uuaaagucuucugauguca

SEQ ID NO: 543 - RNA, 19 nt, Artificial Sequence
  Synthetic oligonucleotide
uaaagucuucugaugucau

SEQ ID NO: 544 - RNA, 19 nt, Artificial Sequence
  Synthetic oligonucleotide
gcauguuguccuuuuuauc

SEQ ID NO: 545 - RNA, 19 nt, Artificial Sequence
  Synthetic oligonucleotide
cauguuguccuuuuuaucu

SEQ ID NO: 546 - RNA, 19 nt, Artificial Sequence
  Synthetic oligonucleotide
auguuguccuuuuuaucug

SEQ ID NO: 547 - RNA, 19 nt, Artificial Sequence
  Synthetic oligonucleotide
uguuguccuuuuuaucuga

SEQ ID NO: 548 - RNA, 19 nt, Artificial Sequence
  Synthetic oligonucleotide
guuguccuuuuuaucugau

SEQ ID NO: 549 - RNA, 19 nt, Artificial Sequence
  Synthetic oligonucleotide
uguccuuuuuaucugaucu

SEQ ID NO: 550 - RNA, 19 nt, Artificial Sequence
  Synthetic oligonucleotide
guccuuuuuaucugaucug

SEQ ID NO: 551 - RNA, 19 nt, Artificial Sequence
  Synthetic oligonucleotide
uccuuuuuaucugaucugu

SEQ ID NO: 552 - RNA, 19 nt, Artificial Sequence
  Synthetic oligonucleotide
ccuuuuuaucugaucugug

SEQ ID NO: 553 - RNA, 19 nt, Artificial Sequence
  Synthetic oligonucleotide
uuuuuaucugaucugugau

SEQ ID NO: 554 - RNA, 19 nt, Artificial Sequence
  Synthetic oligonucleotide
uuuuaucugaucugugauu

SEQ ID NO: 555 - RNA, 19 nt, Artificial Sequence
  Synthetic oligonucleotide
uuuaucugaucugugauua

SEQ ID NO: 556 - RNA, 19 nt, Artificial Sequence
  Synthetic oligonucleotide
gcaguaauauuuuaagaug

SEQ ID NO: 557 - RNA, 19 nt, Artificial Sequence
  Synthetic oligonucleotide
caacuccugaaguuagaaa

SEQ ID NO: 558 - RNA, 19 nt, Artificial Sequence
  Synthetic oligonucleotide
aacuccugaaguuagaaau

SEQ ID NO: 559 - RNA, 19 nt, Artificial Sequence
  Synthetic oligonucleotide
caacugguuagugugaaau

SEQ ID NO: 560 - RNA, 19 nt, Artificial Sequence
  Synthetic oligonucleotide
aacugguuagugugaaaua

SEQ ID NO: 561 - RNA, 19 nt, Artificial Sequence
  Synthetic oligonucleotide
acugguuagugugaaauag

SEQ ID NO: 562 - RNA, 19 nt, Artificial Sequence
  Synthetic oligonucleotide
ugguuagugugaaauaguu

SEQ ID NO: 563 - RNA, 19 nt, Artificial Sequence
  Synthetic oligonucleotide
gauccaguguauaaaucca

SEQ ID NO: 564 - RNA, 19 nt, Artificial Sequence
  Synthetic oligonucleotide
caguguauaaauccaauau

SEQ ID NO: 565 - RNA, 19 nt, Artificial Sequence
  Synthetic oligonucleotide
ucuuauuuugugaacuaua

SEQ ID NO: 566 - RNA, 19 nt, Artificial Sequence
  Synthetic oligonucleotide
cuauaucaguaguguacau

SEQ ID NO: 567 - RNA, 19 nt, Artificial Sequence
  Synthetic oligonucleotide
uaucaguaguguacauuac

SEQ ID NO: 568 - RNA, 19 nt, Artificial Sequence
  Synthetic oligonucleotide
aucaguaguguacauuacc

SEQ ID NO: 569 - RNA, 19 nt, Artificial Sequence
  Synthetic oligonucleotide
gcaaccaacuauccaagug

SEQ ID NO: 570 - RNA, 19 nt, Artificial Sequence
  Synthetic oligonucleotide
caaccaacuauccaagugu

SEQ ID NO: 571 - RNA, 19 nt, Artificial Sequence
  Synthetic oligonucleotide
aaccaacuauccaaguguu

SEQ ID NO: 572 - RNA, 19 nt, Artificial Sequence
  Synthetic oligonucleotide
accaacuauccaaguguua

SEQ ID NO: 573 - RNA, 19 nt, Artificial Sequence
  Synthetic oligonucleotide
aacuauccaaguguuauac

SEQ ID NO: 574 - RNA, 19 nt, Artificial Sequence
  Synthetic oligonucleotide
acuauccaaguguuauacc

SEQ ID NO: 575 - RNA, 19 nt, Artificial Sequence
  Synthetic oligonucleotide
auccaaguguuauaccaac

SEQ ID NO: 576 - RNA, 19 nt, Artificial Sequence
  Synthetic oligonucleotide
uccaaguguuauaccaacu

SEQ ID NO: 577 - RNA, 19 nt, Artificial Sequence
  Synthetic oligonucleotide
ccagaauaagauuacaguu

SEQ ID NO: 578 - RNA, 19 nt, Artificial Sequence
  Synthetic oligonucleotide
cagaauaagauuacaguug

SEQ ID NO: 579 - RNA, 19 nt, Artificial Sequence
  Synthetic oligonucleotide
auaagauuacaguuguugg

SEQ ID NO: 580 - RNA, 19 nt, Artificial Sequence
  Synthetic oligonucleotide
uaagauuacaguuguuggg

SEQ ID NO: 581 - RNA, 19 nt, Artificial Sequence
  Synthetic oligonucleotide
aagauuacaguuguugggg

SEQ ID NO: 582 - RNA, 19 nt, Artificial Sequence
  Synthetic oligonucleotide
agauuacaguuguuggggu

SEQ ID NO: 583 - RNA, 19 nt, Artificial Sequence
  Synthetic oligonucleotide
gauuacaguuguugggguu

SEQ ID NO: 584 - RNA, 19 nt, Artificial Sequence
  Synthetic oligonucleotide
auuacaguuguugggguug

SEQ ID NO: 585 - RNA, 19 nt, Artificial Sequence
  Synthetic oligonucleotide
uuacaguuguugggguugg

SEQ ID NO: 586 - RNA, 19 nt, Artificial Sequence
  Synthetic oligonucleotide
uacaguuguugggguuggu

SEQ ID NO: 587 - RNA, 19 nt, Artificial Sequence
  Synthetic oligonucleotide
caguuguugggguuggugc

SEQ ID NO: 588 - RNA, 19 nt, Artificial Sequence
  Synthetic oligonucleotide
aguuguugggguuggugcu

SEQ ID NO: 589 - RNA, 19 nt, Artificial Sequence
  Synthetic oligonucleotide
ggccugugccaucaguauc

SEQ ID NO: 590 - RNA, 19 nt, Artificial Sequence
  Synthetic oligonucleotide
gccugugccaucaguaucu

SEQ ID NO: 591 - RNA, 19 nt, Artificial Sequence
  Synthetic oligonucleotide
ccugugccaucaguaucuu

SEQ ID NO: 592 - RNA, 19 nt, Artificial Sequence
  Synthetic oligonucleotide
cugugccaucaguaucuua

SEQ ID NO: 593 - RNA, 19 nt, Artificial Sequence
  Synthetic oligonucleotide
ugugccaucaguaucuuaa

SEQ ID NO: 594 - RNA, 19 nt, Artificial Sequence
  Synthetic oligonucleotide
gugccaucaguaucuuaau

SEQ ID NO: 595 - RNA, 19 nt, Artificial Sequence
  Synthetic oligonucleotide
ugccaucaguaucuuaaug

SEQ ID NO: 596 - RNA, 19 nt, Artificial Sequence
  Synthetic oligonucleotide
gccaucaguaucuuaauga

SEQ ID NO: 597 - RNA, 19 nt, Artificial Sequence
  Synthetic oligonucleotide
caguggauaucuugaccua

SEQ ID NO: 598 - RNA, 19 nt, Artificial Sequence
  Synthetic oligonucleotide
uggauaucuugaccuacgu

SEQ ID NO: 599 - RNA, 19 nt, Artificial Sequence
  Synthetic oligonucleotide
ggauaucuugaccuacgug

SEQ ID NO: 600 - RNA, 19 nt, Artificial Sequence
  Synthetic oligonucleotide
gauaucuugaccuacgugg

SEQ ID NO: 601 - RNA, 19 nt, Artificial Sequence
  Synthetic oligonucleotide
auaucuugaccuacguggc

SEQ ID NO: 602 - RNA, 19 nt, Artificial Sequence
  Synthetic oligonucleotide
aucuugaccuacguggcuu

SEQ ID NO: 603 - RNA, 19 nt, Artificial Sequence
  Synthetic oligonucleotide
ucuugaccuacguggcuug

SEQ ID NO: 604 - RNA, 19 nt, Artificial Sequence
  Synthetic oligonucleotide
cuugaccuacguggcuugg

SEQ ID NO: 605 - RNA, 19 nt, Artificial Sequence
  Synthetic oligonucleotide
uuggaagauaagugguuuu

SEQ ID NO: 606 - RNA, 19 nt, Artificial Sequence
  Synthetic oligonucleotide
uggaagauaagugguuuuc

SEQ ID NO: 607 - RNA, 19 nt, Artificial Sequence
  Synthetic oligonucleotide
ugccuguauggaguggaau

SEQ ID NO: 608 - RNA, 19 nt, Artificial Sequence
  Synthetic oligonucleotide
gccuguauggaguggaaug

SEQ ID NO: 609 - RNA, 19 nt, Artificial Sequence
  Synthetic oligonucleotide
aaugaauguugcugguguc

SEQ ID NO: 610 - RNA, 19 nt, Artificial Sequence
  Synthetic oligonucleotide
agggacugauaaagauaag

SEQ ID NO: 611 - RNA, 19 nt, Artificial Sequence
  Synthetic oligonucleotide
cugcaauuuuaaagucuuc

SEQ ID NO: 612 - RNA, 19 nt, Artificial Sequence
  Synthetic oligonucleotide
ugcaauuuuaaagucuucu

SEQ ID NO: 613 - RNA, 19 nt, Artificial Sequence
  Synthetic oligonucleotide
uuuuaaagucuucugaugu

SEQ ID NO: 614 - RNA, 19 nt, Artificial Sequence
  Synthetic oligonucleotide
uuuaaagucuucugauguc

SEQ ID NO: 615 - RNA, 19 nt, Artificial Sequence
  Synthetic oligonucleotide
uuaaagucuucugauguca

SEQ ID NO: 616 - RNA, 19 nt, Artificial Sequence
  Synthetic oligonucleotide
ugcauguuguccuuuuuau

SEQ ID NO: 617 - RNA, 19 nt, Artificial Sequence
  Synthetic oligonucleotide
gcauguuguccuuuuuauc

SEQ ID NO: 618 - RNA, 19 nt, Artificial Sequence
  Synthetic oligonucleotide
cauguuguccuuuuuaucu

SEQ ID NO: 619 - RNA, 19 nt, Artificial Sequence
  Synthetic oligonucleotide
auguuguccuuuuuaucug

SEQ ID NO: 620 - RNA, 19 nt, Artificial Sequence
  Synthetic oligonucleotide
uguuguccuuuuuaucuga

SEQ ID NO: 621 - RNA, 19 nt, Artificial Sequence
  Synthetic oligonucleotide
uuguccuuuuuaucugauc

SEQ ID NO: 622 - RNA, 19 nt, Artificial Sequence
  Synthetic oligonucleotide
uguccuuuuuaucugaucu

SEQ ID NO: 623 - RNA, 19 nt, Artificial Sequence
  Synthetic oligonucleotide
guccuuuuuaucugaucug

SEQ ID NO: 624 - RNA, 19 nt, Artificial Sequence
  Synthetic oligonucleotide
uccuuuuuaucugaucugu

SEQ ID NO: 625 - RNA, 19 nt, Artificial Sequence
  Synthetic oligonucleotide
cuuuuuaucugaucuguga

SEQ ID NO: 626 - RNA, 19 nt, Artificial Sequence
  Synthetic oligonucleotide
uuuuuaucugaucugugau

SEQ ID NO: 627 - RNA, 19 nt, Artificial Sequence
  Synthetic oligonucleotide
uuuuaucugaucugugauu

SEQ ID NO: 628 - RNA, 19 nt, Artificial Sequence
  Synthetic oligonucleotide
agcaguaauauuuuaagau

SEQ ID NO: 629 - RNA, 19 nt, Artificial Sequence
  Synthetic oligonucleotide
ucaacuccugaaguuagaa

SEQ ID NO: 630 - RNA, 19 nt, Artificial Sequence
  Synthetic oligonucleotide
caacuccugaaguuagaaa

SEQ ID NO: 631 - RNA, 19 nt, Artificial Sequence
  Synthetic oligonucleotide
ucaacugguuagugugaaa

SEQ ID NO: 632 - RNA, 19 nt, Artificial Sequence
  Synthetic oligonucleotide
caacugguuagugugaaau

SEQ ID NO: 633 - RNA, 19 nt, Artificial Sequence
  Synthetic oligonucleotide
aacugguuagugugaaaua

SEQ ID NO: 634 - RNA, 19 nt, Artificial Sequence
  Synthetic oligonucleotide
cugguuagugugaaauagu

SEQ ID NO: 635 - RNA, 19 nt, Artificial Sequence
  Synthetic oligonucleotide
ggauccaguguauaaaucc

SEQ ID NO: 636 - RNA, 19 nt, Artificial Sequence
  Synthetic oligonucleotide
ccaguguauaaauccaaua

SEQ ID NO: 637 - RNA, 19 nt, Artificial Sequence
  Synthetic oligonucleotide
aucuuauuuugugaacuau

SEQ ID NO: 638 - RNA, 19 nt, Artificial Sequence
  Synthetic oligonucleotide
acuauaucaguaguguaca

SEQ ID NO: 639 - RNA, 19 nt, Artificial Sequence
  Synthetic oligonucleotide
auaucaguaguguacauua

SEQ ID NO: 640 - RNA, 19 nt, Artificial Sequence
  Synthetic oligonucleotide
uaucaguaguguacauuac

SEQ ID NO: 641 - RNA, 19 nt, Artificial Sequence
  Synthetic oligonucleotide
ugcaaccaacuauccaagu

SEQ ID NO: 642 - RNA, 19 nt, Artificial Sequence
  Synthetic oligonucleotide
gcaaccaacuauccaagug

SEQ ID NO: 643 - RNA, 19 nt, Artificial Sequence
  Synthetic oligonucleotide
caaccaacuauccaagugu

SEQ ID NO: 644 - RNA, 19 nt, Artificial Sequence
  Synthetic oligonucleotide
aaccaacuauccaaguguu

SEQ ID NO: 645 - RNA, 19 nt, Artificial Sequence
  Synthetic oligonucleotide
caacuauccaaguguuaua

SEQ ID NO: 646 - RNA, 19 nt, Artificial Sequence
  Synthetic oligonucleotide
aacuauccaaguguuauac

SEQ ID NO: 647 - RNA, 19 nt, Artificial Sequence
  Synthetic oligonucleotide
uauccaaguguuauaccaa

SEQ ID NO: 648 - RNA, 19 nt, Artificial Sequence
  Synthetic oligonucleotide
auccaaguguuauaccaac

SEQ ID NO: 649 - DNA, 25 bp, Artificial Sequence
  Synthetic oligonucleotide
caaggaccagcugauugugaauctt

SEQ ID NO: 650 - DNA, 25 bp, Artificial Sequence
  Synthetic oligonucleotide
aaggaccagcugauugugaaucutc

SEQ ID NO: 651 - DNA, 25 bp, Artificial Sequence
  Synthetic oligonucleotide
accagcugauugugaaucuucuuaa

SEQ ID NO: 652 - DNA, 25 bp, Artificial Sequence
  Synthetic oligonucleotide
gcugauugugaaucuucuuaaggaa

SEQ ID NO: 653 - DNA, 25 bp, Artificial Sequence
  Synthetic oligonucleotide
cuugugccaucaguaucuuaaugaa

SEQ ID NO: 654 - DNA, 25 bp, Artificial Sequence
  Synthetic oligonucleotide
cccuuguugacgucauggaagacaa

SEQ ID NO: 655 - DNA, 25 bp, Artificial Sequence
  Synthetic oligonucleotide
guugacgucauggaagacaaacuca

SEQ ID NO: 656 - DNA, 25 bp, Artificial Sequence
  Synthetic oligonucleotide
uugacgucauggaagacaaacucaa

SEQ ID NO: 657 - DNA, 25 bp, Artificial Sequence
  Synthetic oligonucleotide
auugucuccagcaaagacuacugtg

SEQ ID NO: 658 - DNA, 25 bp, Artificial Sequence
  Synthetic oligonucleotide
cgaaacgugaacaucuucaaguuca

SEQ ID NO: 659 - DNA, 25 bp, Artificial Sequence
  Synthetic oligonucleotide
cgugaacaucuucaaguucaucatt

SEQ ID NO: 660 - DNA, 25 bp, Artificial Sequence
  Synthetic oligonucleotide
gugaacaucuucaaguucaucautc

SEQ ID NO: 661 - DNA, 25 bp, Artificial Sequence
  Synthetic oligonucleotide
ccgaguaauuggaagugguugcaat

SEQ ID NO: 662 - DNA, 25 bp, Artificial Sequence
  Synthetic oligonucleotide
acgaggugaucaagcugaaagguta

SEQ ID NO: 663 - DNA, 25 bp, Artificial Sequence
  Synthetic oligonucleotide
gcugagagcauaaugaagaaccuta

SEQ ID NO: 664 - DNA, 25 bp, Artificial Sequence
  Synthetic oligonucleotide
gauuaagggucucuauggaaucaat

SEQ ID NO: 665 - DNA, 25 bp, Artificial Sequence
  Synthetic oligonucleotide
aaaauggaaucucggauguugugaa

SEQ ID NO: 666 - DNA, 25 bp, Artificial Sequence
  Synthetic oligonucleotide
ggaaucucggauguugugaagguga

SEQ ID NO: 667 - DNA, 25 bp, Artificial Sequence
  Synthetic oligonucleotide
cggauguugugaaggugacacugac

SEQ ID NO: 668 - DNA, 25 bp, Artificial Sequence
  Synthetic oligonucleotide
gaugcauaucuugugcauaaaugtt

SEQ ID NO: 669 - DNA, 25 bp, Artificial Sequence
  Synthetic oligonucleotide
augcauaucuugugcauaaaugutg

SEQ ID NO: 670 - DNA, 25 bp, Artificial Sequence
  Synthetic oligonucleotide
gcauaucuugugcauaaauguugta

SEQ ID NO: 671 - DNA, 25 bp, Artificial Sequence
  Synthetic oligonucleotide
cauaucuugugcauaaauguuguac

SEQ ID NO: 672 - DNA, 25 bp, Artificial Sequence
  Synthetic oligonucleotide
auaucuugugcauaaauguuguaca

SEQ ID NO: 673 - DNA, 25 bp, Artificial Sequence
  Synthetic oligonucleotide
aucuugugcauaaauguuguacagg

SEQ ID NO: 674 - DNA, 25 bp, Artificial Sequence
  Synthetic oligonucleotide
ucuugugcauaaauguuguacagga

SEQ ID NO: 675 - DNA, 25 bp, Artificial Sequence
  Synthetic oligonucleotide
uugugcauaaauguuguacaggata

SEQ ID NO: 676 - DNA, 25 bp, Artificial Sequence
  Synthetic oligonucleotide
ugugcauaaauguuguacaggauat

SEQ ID NO: 677 - DNA, 25 bp, Artificial Sequence
  Synthetic oligonucleotide
gugcauaaauguuguacaggauatt

SEQ ID NO: 678 - DNA, 25 bp, Artificial Sequence
  Synthetic oligonucleotide
ugcauaaauguuguacaggauautt

SEQ ID NO: 679 - DNA, 25 bp, Artificial Sequence
  Synthetic oligonucleotide
gcauaaauguuguacaggauauutt

SEQ ID NO: 680 - DNA, 25 bp, Artificial Sequence
  Synthetic oligonucleotide
cauaaauguuguacaggauauuuta

SEQ ID NO: 681 - DNA, 25 bp, Artificial Sequence
  Synthetic oligonucleotide
auaaauguuguacaggauauuuuat

SEQ ID NO: 682 - DNA, 25 bp, Artificial Sequence
  Synthetic oligonucleotide
uaaauguuguacaggauauuuuata

SEQ ID NO: 683 - DNA, 25 bp, Artificial Sequence
  Synthetic oligonucleotide
aaauguuguacaggauauuuuauat

SEQ ID NO: 684 - DNA, 25 bp, Artificial Sequence
  Synthetic oligonucleotide
aauguuguacaggauauuuuauata

SEQ ID NO: 685 - DNA, 25 bp, Artificial Sequence
  Synthetic oligonucleotide
auguuguacaggauauuuuauauat

SEQ ID NO: 686 - DNA, 25 bp, Artificial Sequence
  Synthetic oligonucleotide
uguuguacaggauauuuuauauatt

SEQ ID NO: 687 - DNA, 25 bp, Artificial Sequence
  Synthetic oligonucleotide
guuguacaggauauuuuauauauta

SEQ ID NO: 688 - DNA, 25 bp, Artificial Sequence
  Synthetic oligonucleotide
uuguacaggauauuuuauauauuat

SEQ ID NO: 689 - DNA, 25 bp, Artificial Sequence
  Synthetic oligonucleotide
gucuguagugugcauugcaauauta

SEQ ID NO: 690 - DNA, 25 bp, Artificial Sequence
  Synthetic oligonucleotide
guagugugcauugcaauauuaugtg

SEQ ID NO: 691 - DNA, 25 bp, Artificial Sequence
  Synthetic oligonucleotide
uagugugcauugcaauauuauguga

SEQ ID NO: 692 - DNA, 25 bp, Artificial Sequence
  Synthetic oligonucleotide
gugugcauugcaauauuaugugaga

SEQ ID NO: 693 - DNA, 25 bp, Artificial Sequence
  Synthetic oligonucleotide
cauugcaauauuaugugagauguaa

SEQ ID NO: 694 - DNA, 25 bp, Artificial Sequence
  Synthetic oligonucleotide
auugcaauauuaugugagauguaag

SEQ ID NO: 695 - DNA, 25 bp, Artificial Sequence
  Synthetic oligonucleotide
gcaauauuaugugagauguaagatc

SEQ ID NO: 696 - DNA, 25 bp, Artificial Sequence
  Synthetic oligonucleotide
caauauuaugugagauguaagauct

SEQ ID NO: 697 - RNA, 27 nt, Artificial Sequence
  Synthetic oligonucleotide
aagauucacaaucagcugguccuugag

SEQ ID NO: 698 - RNA, 27 nt, Artificial Sequence
  Synthetic oligonucleotide
gaagauucacaaucagcugguccuuga

SEQ ID NO: 699 - RNA, 27 nt, Artificial Sequence
  Synthetic oligonucleotide
uuaagaagauucacaaucagcuggucc

SEQ ID NO: 700 - RNA, 27 nt, Artificial Sequence
  Synthetic oligonucleotide
uuccuuaagaagauucacaaucagcug

SEQ ID NO: 701 - RNA, 27 nt, Artificial Sequence
  Synthetic oligonucleotide
uucauuaagauacugauggcacaagcc

SEQ ID NO: 702 - RNA, 27 nt, Artificial Sequence
  Synthetic oligonucleotide
uugucuuccaugacgucaacaagggca

SEQ ID NO: 703 - RNA, 27 nt, Artificial Sequence
  Synthetic oligonucleotide
ugaguuugucuuccaugacgucaacaa

SEQ ID NO: 704 - RNA, 27 nt, Artificial Sequence
  Synthetic oligonucleotide
uugaguuugucuuccaugacgucaaca

SEQ ID NO: 705 - RNA, 27 nt, Artificial Sequence
  Synthetic oligonucleotide
cacaguagucuuugcuggagacaauuu

SEQ ID NO: 706 - RNA, 27 nt, Artificial Sequence
  Synthetic oligonucleotide
ugaacuugaagauguucacguuucgcu

SEQ ID NO: 707 - RNA, 27 nt, Artificial Sequence
  Synthetic oligonucleotide
aaugaugaacuugaagauguucacguu

SEQ ID NO: 708 - RNA, 27 nt, Artificial Sequence
  Synthetic oligonucleotide
gaaugaugaacuugaagauguucacgu

SEQ ID NO: 709 - RNA, 27 nt, Artificial Sequence
  Synthetic oligonucleotide
auugcaaccacuuccaauuacucgguu

SEQ ID NO: 710 - RNA, 27 nt, Artificial Sequence
  Synthetic oligonucleotide
uaaccuuucagcuugaucaccucguag

SEQ ID NO: 711 - RNA, 27 nt, Artificial Sequence
  Synthetic oligonucleotide
uaagguucuucauuaugcucucagcca

SEQ ID NO: 712 - RNA, 27 nt, Artificial Sequence
  Synthetic oligonucleotide
auugauuccauagagacccuuaaucau

SEQ ID NO: 713 - RNA, 27 nt, Artificial Sequence
  Synthetic oligonucleotide
uucacaacauccgagauuccauuuugu

SEQ ID NO: 714 - RNA, 27 nt, Artificial Sequence
  Synthetic oligonucleotide
ucaccuucacaacauccgagauuccau

SEQ ID NO: 715 - RNA, 27 nt, Artificial Sequence
  Synthetic oligonucleotide
gucagugucaccuucacaacauccgag

SEQ ID NO: 716 - RNA, 27 nt, Artificial Sequence
  Synthetic oligonucleotide
aacauuuaugcacaagauaugcaucau

SEQ ID NO: 717 - RNA, 27 nt, Artificial Sequence
  Synthetic oligonucleotide
caacauuuaugcacaagauaugcauca

SEQ ID NO: 718 - RNA, 27 nt, Artificial Sequence
  Synthetic oligonucleotide
uacaacauuuaugcacaagauaugcau

SEQ ID NO: 719 - RNA, 27 nt, Artificial Sequence
  Synthetic oligonucleotide
guacaacauuuaugcacaagauaugca

SEQ ID NO: 720 - RNA, 27 nt, Artificial Sequence
  Synthetic oligonucleotide
uguacaacauuuaugcacaagauaugc

SEQ ID NO: 721 - RNA, 27 nt, Artificial Sequence
  Synthetic oligonucleotide
ccuguacaacauuuaugcacaagauau

SEQ ID NO: 722 - RNA, 27 nt, Artificial Sequence
  Synthetic oligonucleotide
uccuguacaacauuuaugcacaagaua

SEQ ID NO: 723 - RNA, 27 nt, Artificial Sequence
  Synthetic oligonucleotide
uauccuguacaacauuuaugcacaaga

SEQ ID NO: 724 - RNA, 27 nt, Artificial Sequence
  Synthetic oligonucleotide
auauccuguacaacauuuaugcacaag

SEQ ID NO: 725 - RNA, 27 nt, Artificial Sequence
  Synthetic oligonucleotide
aauauccuguacaacauuuaugcacaa

SEQ ID NO: 726 - RNA, 27 nt, Artificial Sequence
  Synthetic oligonucleotide
aaauauccuguacaacauuuaugcaca

SEQ ID NO: 727 - RNA, 27 nt, Artificial Sequence
  Synthetic oligonucleotide
aaaauauccuguacaacauuuaugcac

SEQ ID NO: 728 - RNA, 27 nt, Artificial Sequence
  Synthetic oligonucleotide
uaaaauauccuguacaacauuuaugca

SEQ ID NO: 729 - RNA, 27 nt, Artificial Sequence
  Synthetic oligonucleotide
auaaaauauccuguacaacauuuaugc

SEQ ID NO: 730 - RNA, 27 nt, Artificial Sequence
  Synthetic oligonucleotide
uauaaaauauccuguacaacauuuaug

SEQ ID NO: 731 - RNA, 27 nt, Artificial Sequence
  Synthetic oligonucleotide
auauaaaauauccuguacaacauuuau

SEQ ID NO: 732 - RNA, 27 nt, Artificial Sequence
  Synthetic oligonucleotide
uauauaaaauauccuguacaacauuua

SEQ ID NO: 733 - RNA, 27 nt, Artificial Sequence
  Synthetic oligonucleotide
auauauaaaauauccuguacaacauuu

SEQ ID NO: 734 - RNA, 27 nt, Artificial Sequence
  Synthetic oligonucleotide
aauauauaaaauauccuguacaacauu

SEQ ID NO: 735 - RNA, 27 nt, Artificial Sequence
  Synthetic oligonucleotide
uaauauauaaaauauccuguacaacau

SEQ ID NO: 736 - RNA, 27 nt, Artificial Sequence
  Synthetic oligonucleotide
auaauauauaaaauauccuguacaaca

SEQ ID NO: 737 - RNA, 27 nt, Artificial Sequence
  Synthetic oligonucleotide
uaauauugcaaugcacacuacagacac

SEQ ID NO: 738 - RNA, 27 nt, Artificial Sequence
  Synthetic oligonucleotide
cacauaauauugcaaugcacacuacag

SEQ ID NO: 739 - RNA, 27 nt, Artificial Sequence
  Synthetic oligonucleotide
ucacauaauauugcaaugcacacuaca

SEQ ID NO: 740 - RNA, 27 nt, Artificial Sequence
  Synthetic oligonucleotide
ucucacauaauauugcaaugcacacua

SEQ ID NO: 741 - RNA, 27 nt, Artificial Sequence
  Synthetic oligonucleotide
uuacaucucacauaauauugcaaugca

SEQ ID NO: 742 - RNA, 27 nt, Artificial Sequence
  Synthetic oligonucleotide
cuuacaucucacauaauauugcaaugc

SEQ ID NO: 743 - RNA, 27 nt, Artificial Sequence
  Synthetic oligonucleotide
gaucuuacaucucacauaauauugcaa

SEQ ID NO: 744 - RNA, 27 nt, Artificial Sequence
  Synthetic oligonucleotide
agaucuuacaucucacauaauauugca

SEQ ID NO: 745 - DNA, 27 bp, Artificial Sequence
  Synthetic oligonucleotide
ctcaaggaccagctgattgtgaatctt

SEQ ID NO: 746 - DNA, 27 bp, Artificial Sequence
  Synthetic oligonucleotide
tcaaggaccagctgattgtgaatcttc

SEQ ID NO: 747 - DNA, 27 bp, Artificial Sequence
  Synthetic oligonucleotide
ggaccagctgattgtgaatcttcttaa

SEQ ID NO: 748 - DNA, 27 bp, Artificial Sequence
  Synthetic oligonucleotide
cagctgattgtgaatcttcttaaggaa

SEQ ID NO: 749 - DNA, 27 bp, Artificial Sequence
  Synthetic oligonucleotide
ggcttgtgccatcagtatcttaatgaa

SEQ ID NO: 750 - DNA, 27 bp, Artificial Sequence
  Synthetic oligonucleotide
tgcccttgttgacgtcatggaagacaa

SEQ ID NO: 751 - DNA, 27 bp, Artificial Sequence
  Synthetic oligonucleotide
ttgttgacgtcatggaagacaaactca

SEQ ID NO: 752 - DNA, 27 bp, Artificial Sequence
  Synthetic oligonucleotide
tgttgacgtcatggaagacaaactcaa

SEQ ID NO: 753 - DNA, 27 bp, Artificial Sequence
  Synthetic oligonucleotide
aaattgtctccagcaaagactactgtg

SEQ ID NO: 754 - DNA, 27 bp, Artificial Sequence
  Synthetic oligonucleotide
agcgaaacgtgaacatcttcaagttca

SEQ ID NO: 755 - DNA, 27 bp, Artificial Sequence
  Synthetic oligonucleotide
aacgtgaacatcttcaagttcatcatt

SEQ ID NO: 756 - DNA, 27 bp, Artificial Sequence
  Synthetic oligonucleotide
acgtgaacatcttcaagttcatcattc

SEQ ID NO: 757 - DNA, 27 bp, Artificial Sequence
  Synthetic oligonucleotide
aaccgagtaattggaagtggttgcaat

SEQ ID NO: 758 - DNA, 27 bp, Artificial Sequence
  Synthetic oligonucleotide
ctacgaggtgatcaagctgaaaggtta

SEQ ID NO: 759 - DNA, 27 bp, Artificial Sequence
  Synthetic oligonucleotide
tggctgagagcataatgaagaacctta

SEQ ID NO: 760 - DNA, 27 bp, Artificial Sequence
  Synthetic oligonucleotide
atgattaagggtctctatggaatcaat

SEQ ID NO: 761 - DNA, 27 bp, Artificial Sequence
  Synthetic oligonucleotide
acaaaatggaatctcggatgttgtgaa

SEQ ID NO: 762 - DNA, 27 bp, Artificial Sequence
  Synthetic oligonucleotide
atggaatctcggatgttgtgaaggtga

SEQ ID NO: 763 - DNA, 27 bp, Artificial Sequence
  Synthetic oligonucleotide
ctcggatgttgtgaaggtgacactgac

SEQ ID NO: 764 - DNA, 27 bp, Artificial Sequence
  Synthetic oligonucleotide
atgatgcatatcttgtgcataaatgtt

SEQ ID NO: 765 - DNA, 27 bp, Artificial Sequence
  Synthetic oligonucleotide
tgatgcatatcttgtgcataaatgttg

SEQ ID NO: 766 - DNA, 27 bp, Artificial Sequence
  Synthetic oligonucleotide
atgcatatcttgtgcataaatgttgta

SEQ ID NO: 767 - DNA, 27 bp, Artificial Sequence
  Synthetic oligonucleotide
tgcatatcttgtgcataaatgttgtac

SEQ ID NO: 768 - DNA, 27 bp, Artificial Sequence
  Synthetic oligonucleotide
gcatatcttgtgcataaatgttgtaca

SEQ ID NO: 769 - DNA, 27 bp, Artificial Sequence
  Synthetic oligonucleotide
atatcttgtgcataaatgttgtacagg

SEQ ID NO: 770 - DNA, 27 bp, Artificial Sequence
  Synthetic oligonucleotide
tatcttgtgcataaatgttgtacagga

SEQ ID NO: 771 - DNA, 27 bp, Artificial Sequence
  Synthetic oligonucleotide
tcttgtgcataaatgttgtacaggata

SEQ ID NO: 772 - DNA, 27 bp, Artificial Sequence
  Synthetic oligonucleotide
cttgtgcataaatgttgtacaggatat

SEQ ID NO: 773 - DNA, 27 bp, Artificial Sequence
  Synthetic oligonucleotide
ttgtgcataaatgttgtacaggatatt

SEQ ID NO: 774 - DNA, 27 bp, Artificial Sequence
  Synthetic oligonucleotide
tgtgcataaatgttgtacaggatattt

SEQ ID NO: 775 - DNA, 27 bp, Artificial Sequence
  Synthetic oligonucleotide
gtgcataaatgttgtacaggatatttt

SEQ ID NO: 776 - DNA, 27 bp, Artificial Sequence
  Synthetic oligonucleotide
tgcataaatgttgtacaggatatttta

SEQ ID NO: 777 - DNA, 27 bp, Artificial Sequence
  Synthetic oligonucleotide
gcataaatgttgtacaggatattttat

SEQ ID NO: 778 - DNA, 27 bp, Artificial Sequence
  Synthetic oligonucleotide
cataaatgttgtacaggatattttata

SEQ ID NO: 779 - DNA, 27 bp, Artificial Sequence
  Synthetic oligonucleotide
ataaatgttgtacaggatattttatat

SEQ ID NO: 780 - DNA, 27 bp, Artificial Sequence
  Synthetic oligonucleotide
taaatgttgtacaggatattttatata

SEQ ID NO: 781 - DNA, 27 bp, Artificial Sequence
  Synthetic oligonucleotide
aaatgttgtacaggatattttatatat

SEQ ID NO: 782 - DNA, 27 bp, Artificial Sequence
  Synthetic oligonucleotide
aatgttgtacaggatattttatatatt

SEQ ID NO: 783 - DNA, 27 bp, Artificial Sequence
  Synthetic oligonucleotide
atgttgtacaggatattttatatatta

SEQ ID NO: 784 - DNA, 27 bp, Artificial Sequence
  Synthetic oligonucleotide
tgttgtacaggatattttatatattat

SEQ ID NO: 785 - DNA, 27 bp, Artificial Sequence
  Synthetic oligonucleotide
gtgtctgtagtgtgcattgcaatatta

SEQ ID NO: 786 - DNA, 27 bp, Artificial Sequence
  Synthetic oligonucleotide
ctgtagtgtgcattgcaatattatgtg

SEQ ID NO: 787 - DNA, 27 bp, Artificial Sequence
  Synthetic oligonucleotide
tgtagtgtgcattgcaatattatgtga

SEQ ID NO: 788 - DNA, 27 bp, Artificial Sequence
  Synthetic oligonucleotide
tagtgtgcattgcaatattatgtgaga

SEQ ID NO: 789 - DNA, 27 bp, Artificial Sequence
  Synthetic oligonucleotide
tgcattgcaatattatgtgagatgtaa

SEQ ID NO: 790 - DNA, 27 bp, Artificial Sequence
  Synthetic oligonucleotide
gcattgcaatattatgtgagatgtaag

SEQ ID NO: 791 - DNA, 27 bp, Artificial Sequence
  Synthetic oligonucleotide
ttgcaatattatgtgagatgtaagatc

SEQ ID NO: 792 - DNA, 27 bp, Artificial Sequence
  Synthetic oligonucleotide
tgcaatattatgtgagatgtaagatct

SEQ ID NO: 793 - RNA, 25 nt, Artificial Sequence
  Synthetic oligonucleotide
caaggaccagcugauugugaaucuu

SEQ ID NO: 794 - RNA, 25 nt, Artificial Sequence
  Synthetic oligonucleotide
aaggaccagcugauugugaaucuuc

SEQ ID NO: 795 - RNA, 25 nt, Artificial Sequence
  Synthetic oligonucleotide
accagcugauugugaaucuucuuaa

SEQ ID NO: 796 - RNA, 25 nt, Artificial Sequence
  Synthetic oligonucleotide
gcugauugugaaucuucuuaaggaa

SEQ ID NO: 797 - RNA, 25 nt, Artificial Sequence
  Synthetic oligonucleotide
cuugugccaucaguaucuuaaugaa

SEQ ID NO: 798 - RNA, 25 nt, Artificial Sequence
  Synthetic oligonucleotide
cccuuguugacgucauggaagacaa

SEQ ID NO: 799 - RNA, 25 nt, Artificial Sequence
  Synthetic oligonucleotide
guugacgucauggaagacaaacuca

SEQ ID NO: 800 - RNA, 25 nt, Artificial Sequence
  Synthetic oligonucleotide
uugacgucauggaagacaaacucaa

SEQ ID NO: 801 - RNA, 25 nt, Artificial Sequence
  Synthetic oligonucleotide
auugucuccagcaaagacuacugug

SEQ ID NO: 802 - RNA, 25 nt, Artificial Sequence
  Synthetic oligonucleotide
cgaaacgugaacaucuucaaguuca

SEQ ID NO: 803 - RNA, 25 nt, Artificial Sequence
  Synthetic oligonucleotide
cgugaacaucuucaaguucaucauu

SEQ ID NO: 804 - RNA, 25 nt, Artificial Sequence
  Synthetic oligonucleotide
gugaacaucuucaaguucaucauuc

SEQ ID NO: 805 - RNA, 25 nt, Artificial Sequence
  Synthetic oligonucleotide
ccgaguaauuggaagugguugcaau

SEQ ID NO: 806 - RNA, 25 nt, Artificial Sequence
  Synthetic oligonucleotide
acgaggugaucaagcugaaagguua

SEQ ID NO: 807 - RNA, 25 nt, Artificial Sequence
  Synthetic oligonucleotide
gcugagagcauaaugaagaaccuua

SEQ ID NO: 808 - RNA, 25 nt, Artificial Sequence
  Synthetic oligonucleotide
gauuaagggucucuauggaaucaau

SEQ ID NO: 809 - RNA, 25 nt, Artificial Sequence
  Synthetic oligonucleotide
aaaauggaaucucggauguugugaa

SEQ ID NO: 810 - RNA, 25 nt, Artificial Sequence
  Synthetic oligonucleotide
ggaaucucggauguugugaagguga

SEQ ID NO: 811 - RNA, 25 nt, Artificial Sequence
  Synthetic oligonucleotide
cggauguugugaaggugacacugac

SEQ ID NO: 812 - RNA, 25 nt, Artificial Sequence
  Synthetic oligonucleotide
gaugcauaucuugugcauaaauguu

SEQ ID NO: 813 - RNA, 25 nt, Artificial Sequence
  Synthetic oligonucleotide
augcauaucuugugcauaaauguug

SEQ ID NO: 814 - RNA, 25 nt, Artificial Sequence
  Synthetic oligonucleotide
gcauaucuugugcauaaauguugua

SEQ ID NO: 815 - RNA, 25 nt, Artificial Sequence
  Synthetic oligonucleotide
cauaucuugugcauaaauguuguac

SEQ ID NO: 816 - RNA, 25 nt, Artificial Sequence
  Synthetic oligonucleotide
auaucuugugcauaaauguuguaca

SEQ ID NO: 817 - RNA, 25 nt, Artificial Sequence
  Synthetic oligonucleotide
aucuugugcauaaauguuguacagg

SEQ ID NO: 818 - RNA, 25 nt, Artificial Sequence
  Synthetic oligonucleotide
ucuugugcauaaauguuguacagga

SEQ ID NO: 819 - RNA, 25 nt, Artificial Sequence
  Synthetic oligonucleotide
uugugcauaaauguuguacaggaua

SEQ ID NO: 820 - RNA, 25 nt, Artificial Sequence
  Synthetic oligonucleotide
ugugcauaaauguuguacaggauau

SEQ ID NO: 821 - RNA, 25 nt, Artificial Sequence
  Synthetic oligonucleotide
gugcauaaauguuguacaggauauu

SEQ ID NO: 822 - RNA, 25 nt, Artificial Sequence
  Synthetic oligonucleotide
ugcauaaauguuguacaggauauuu

SEQ ID NO: 823 - RNA, 25 nt, Artificial Sequence
  Synthetic oligonucleotide
gcauaaauguuguacaggauauuuu

SEQ ID NO: 824 - RNA, 25 nt, Artificial Sequence
  Synthetic oligonucleotide
cauaaauguuguacaggauauuuua

SEQ ID NO: 825 - RNA, 25 nt, Artificial Sequence
  Synthetic oligonucleotide
auaaauguuguacaggauauuuuau

SEQ ID NO: 826 - RNA, 25 nt, Artificial Sequence
  Synthetic oligonucleotide
uaaauguuguacaggauauuuuaua

SEQ ID NO: 827 - RNA, 25 nt, Artificial Sequence
  Synthetic oligonucleotide
aaauguuguacaggauauuuuauau

SEQ ID NO: 828 - RNA, 25 nt, Artificial Sequence
  Synthetic oligonucleotide
aauguuguacaggauauuuuauaua

SEQ ID NO: 829 - RNA, 25 nt, Artificial Sequence
  Synthetic oligonucleotide
auguuguacaggauauuuuauauau

SEQ ID NO: 830 - RNA, 25 nt, Artificial Sequence
  Synthetic oligonucleotide
uguuguacaggauauuuuauauauu

SEQ ID NO: 831 - RNA, 25 nt, Artificial Sequence
  Synthetic oligonucleotide
guuguacaggauauuuuauauauua

SEQ ID NO: 832 - RNA, 25 nt, Artificial Sequence
  Synthetic oligonucleotide
uuguacaggauauuuuauauauuau

SEQ ID NO: 833 - RNA, 25 nt, Artificial Sequence
  Synthetic oligonucleotide
gucuguagugugcauugcaauauua

SEQ ID NO: 834 - RNA, 25 nt, Artificial Sequence
  Synthetic oligonucleotide
guagugugcauugcaauauuaugug

SEQ ID NO: 835 - RNA, 25 nt, Artificial Sequence
  Synthetic oligonucleotide
uagugugcauugcaauauuauguga

SEQ ID NO: 836 - RNA, 25 nt, Artificial Sequence
  Synthetic oligonucleotide
gugugcauugcaauauuaugugaga

SEQ ID NO: 837 - RNA, 25 nt, Artificial Sequence
  Synthetic oligonucleotide
cauugcaauauuaugugagauguaa

SEQ ID NO: 838 - RNA, 25 nt, Artificial Sequence
  Synthetic oligonucleotide
auugcaauauuaugugagauguaag

SEQ ID NO: 839 - RNA, 25 nt, Artificial Sequence
  Synthetic oligonucleotide
gcaauauuaugugagauguaagauc

SEQ ID NO: 840 - RNA, 25 nt, Artificial Sequence
  Synthetic oligonucleotide
caauauuaugugagauguaagaucu

SEQ ID NO: 841 - RNA, 21 nt, Artificial Sequence
  Synthetic oligonucleotide
cucaaggaccagcugauugug

SEQ ID NO: 842 - RNA, 21 nt, Artificial Sequence
  Synthetic oligonucleotide
ucaaggaccagcugauuguga

SEQ ID NO: 843 - RNA, 21 nt, Artificial Sequence
  Synthetic oligonucleotide
ggaccagcugauugugaaucu

SEQ ID NO: 844 - RNA, 21 nt, Artificial Sequence
  Synthetic oligonucleotide
cagcugauugugaaucuucuu

SEQ ID NO: 845 - RNA, 21 nt, Artificial Sequence
  Synthetic oligonucleotide
ggcuugugccaucaguaucuu

SEQ ID NO: 846 - RNA, 21 nt, Artificial Sequence
  Synthetic oligonucleotide
ugcccuuguugacgucaugga

SEQ ID NO: 847 - RNA, 21 nt, Artificial Sequence
  Synthetic oligonucleotide
uuguugacgucauggaagaca

SEQ ID NO: 848 - RNA, 21 nt, Artificial Sequence
  Synthetic oligonucleotide
uguugacgucauggaagacaa

SEQ ID NO: 849 - RNA, 21 nt, Artificial Sequence
  Synthetic oligonucleotide
aaauugucuccagcaaagacu

SEQ ID NO: 850 - RNA, 21 nt, Artificial Sequence
  Synthetic oligonucleotide
agcgaaacgugaacaucuuca

SEQ ID NO: 851 - RNA, 21 nt, Artificial Sequence
  Synthetic oligonucleotide
aacgugaacaucuucaaguuc

SEQ ID NO: 852 - RNA, 21 nt, Artificial Sequence
  Synthetic oligonucleotide
acgugaacaucuucaaguuca

SEQ ID NO: 853 - RNA, 21 nt, Artificial Sequence
  Synthetic oligonucleotide
aaccgaguaauuggaaguggu

SEQ ID NO: 854 - RNA, 21 nt, Artificial Sequence
  Synthetic oligonucleotide
cuacgaggugaucaagcugaa

SEQ ID NO: 855 - RNA, 21 nt, Artificial Sequence
  Synthetic oligonucleotide
uggcugagagcauaaugaaga

SEQ ID NO: 856 - RNA, 21 nt, Artificial Sequence
  Synthetic oligonucleotide
augauuaagggucucuaugga

SEQ ID NO: 857 - RNA, 21 nt, Artificial Sequence
  Synthetic oligonucleotide
acaaaauggaaucucggaugu

SEQ ID NO: 858 - RNA, 21 nt, Artificial Sequence
  Synthetic oligonucleotide
auggaaucucggauguuguga

SEQ ID NO: 859 - RNA, 21 nt, Artificial Sequence
  Synthetic oligonucleotide
cucggauguugugaaggugac

SEQ ID NO: 860 - RNA, 21 nt, Artificial Sequence
  Synthetic oligonucleotide
augaugcauaucuugugcaua

SEQ ID NO: 861 - RNA, 21 nt, Artificial Sequence
  Synthetic oligonucleotide
ugaugcauaucuugugcauaa

SEQ ID NO: 862 - RNA, 21 nt, Artificial Sequence
  Synthetic oligonucleotide
augcauaucuugugcauaaau

SEQ ID NO: 863 - RNA, 21 nt, Artificial Sequence
  Synthetic oligonucleotide
ugcauaucuugugcauaaaug

SEQ ID NO: 864 - RNA, 21 nt, Artificial Sequence
  Synthetic oligonucleotide
gcauaucuugugcauaaaugu

SEQ ID NO: 865 - RNA, 21 nt, Artificial Sequence
  Synthetic oligonucleotide
auaucuugugcauaaauguug

SEQ ID NO: 866 - RNA, 21 nt, Artificial Sequence
  Synthetic oligonucleotide
uaucuugugcauaaauguugu

SEQ ID NO: 867 - RNA, 21 nt, Artificial Sequence
  Synthetic oligonucleotide
ucuugugcauaaauguuguac

SEQ ID NO: 868 - RNA, 21 nt, Artificial Sequence
  Synthetic oligonucleotide
cuugugcauaaauguuguaca

SEQ ID NO: 869 - RNA, 21 nt, Artificial Sequence
  Synthetic oligonucleotide
uugugcauaaauguuguacag

SEQ ID NO: 870 - RNA, 21 nt, Artificial Sequence
  Synthetic oligonucleotide
ugugcauaaauguuguacagg

SEQ ID NO: 871 - RNA, 21 nt, Artificial Sequence
  Synthetic oligonucleotide
gugcauaaauguuguacagga

SEQ ID NO: 872 - RNA, 21 nt, Artificial Sequence
  Synthetic oligonucleotide
ugcauaaauguuguacaggau

SEQ ID NO: 873 - RNA, 21 nt, Artificial Sequence
  Synthetic oligonucleotide
gcauaaauguuguacaggaua

SEQ ID NO: 874 - RNA, 21 nt, Artificial Sequence
  Synthetic oligonucleotide
cauaaauguuguacaggauau

SEQ ID NO: 875 - RNA, 21 nt, Artificial Sequence
  Synthetic oligonucleotide
auaaauguuguacaggauauu

SEQ ID NO: 876 - RNA, 21 nt, Artificial Sequence
  Synthetic oligonucleotide
uaaauguuguacaggauauuu

SEQ ID NO: 877 - RNA, 21 nt, Artificial Sequence
  Synthetic oligonucleotide
aaauguuguacaggauauuuu

SEQ ID NO: 878 - RNA, 21 nt, Artificial Sequence
  Synthetic oligonucleotide
aauguuguacaggauauuuua

SEQ ID NO: 879 - RNA, 21 nt, Artificial Sequence
  Synthetic oligonucleotide
auguuguacaggauauuuuau

SEQ ID NO: 880 - RNA, 21 nt, Artificial Sequence
  Synthetic oligonucleotide
uguuguacaggauauuuuaua

SEQ ID NO: 881 - RNA, 21 nt, Artificial Sequence
  Synthetic oligonucleotide
gugucuguagugugcauugca

SEQ ID NO: 882 - RNA, 21 nt, Artificial Sequence
  Synthetic oligonucleotide
cuguagugugcauugcaauau

SEQ ID NO: 883 - RNA, 21 nt, Artificial Sequence
  Synthetic oligonucleotide
uguagugugcauugcaauauu

SEQ ID NO: 884 - RNA, 21 nt, Artificial Sequence
  Synthetic oligonucleotide
uagugugcauugcaauauuau

SEQ ID NO: 885 - RNA, 21 nt, Artificial Sequence
  Synthetic oligonucleotide
ugcauugcaauauuaugugag

SEQ ID NO: 886 - RNA, 21 nt, Artificial Sequence
  Synthetic oligonucleotide
gcauugcaauauuaugugaga

SEQ ID NO: 887 - RNA, 21 nt, Artificial Sequence
  Synthetic oligonucleotide
uugcaauauuaugugagaugu

SEQ ID NO: 888 - RNA, 21 nt, Artificial Sequence
  Synthetic oligonucleotide
ugcaauauuaugugagaugua

SEQ ID NO: 889 - RNA, 27 nt, Artificial Sequence
  Synthetic oligonucleotide
cucaaggaccagcugauugugaaucuu

SEQ ID NO: 890 - RNA, 27 nt, Artificial Sequence
  Synthetic oligonucleotide
ucaaggaccagcugauugugaaucuuc

SEQ ID NO: 891 - RNA, 27 nt, Artificial Sequence
  Synthetic oligonucleotide
ggaccagcugauugugaaucuucuuaa

SEQ ID NO: 892 - RNA, 27 nt, Artificial Sequence
  Synthetic oligonucleotide
cagcugauugugaaucuucuuaaggaa

SEQ ID NO: 893 - RNA, 27 nt, Artificial Sequence
  Synthetic oligonucleotide
ggcuugugccaucaguaucuuaaugaa

SEQ ID NO: 894 - RNA, 27 nt, Artificial Sequence
  Synthetic oligonucleotide
ugcccuuguugacgucauggaagacaa

SEQ ID NO: 895 - RNA, 27 nt, Artificial Sequence
  Synthetic oligonucleotide
uuguugacgucauggaagacaaacuca

SEQ ID NO: 896 - RNA, 27 nt, Artificial Sequence
  Synthetic oligonucleotide
uguugacgucauggaagacaaacucaa

SEQ ID NO: 897 - RNA, 27 nt, Artificial Sequence
  Synthetic oligonucleotide
aaauugucuccagcaaagacuacugug

SEQ ID NO: 898 - RNA, 27 nt, Artificial Sequence
  Synthetic oligonucleotide
agcgaaacgugaacaucuucaaguuca

SEQ ID NO: 899 - RNA, 27 nt, Artificial Sequence
  Synthetic oligonucleotide
aacgugaacaucuucaaguucaucauu

SEQ ID NO: 900 - RNA, 27 nt, Artificial Sequence
  Synthetic oligonucleotide
acgugaacaucuucaaguucaucauuc

SEQ ID NO: 901 - RNA, 27 nt, Artificial Sequence
  Synthetic oligonucleotide
aaccgaguaauuggaagugguugcaau

SEQ ID NO: 902 - RNA, 27 nt, Artificial Sequence
  Synthetic oligonucleotide
cuacgaggugaucaagcugaaagguua

SEQ ID NO: 903 - RNA, 27 nt, Artificial Sequence
  Synthetic oligonucleotide
uggcugagagcauaaugaagaaccuua

SEQ ID NO: 904 - RNA, 27 nt, Artificial Sequence
  Synthetic oligonucleotide
augauuaagggucucuauggaaucaau

SEQ ID NO: 905 - RNA, 27 nt, Artificial Sequence
  Synthetic oligonucleotide
acaaaauggaaucucggauguugugaa

SEQ ID NO: 906 - RNA, 27 nt, Artificial Sequence
  Synthetic oligonucleotide
auggaaucucggauguugugaagguga

SEQ ID NO: 907 - RNA, 27 nt, Artificial Sequence
  Synthetic oligonucleotide
cucggauguugugaaggugacacugac

SEQ ID NO: 908 - RNA, 27 nt, Artificial Sequence
  Synthetic oligonucleotide
augaugcauaucuugugcauaaauguu

SEQ ID NO: 909 - RNA, 27 nt, Artificial Sequence
  Synthetic oligonucleotide
ugaugcauaucuugugcauaaauguug

SEQ ID NO: 910 - RNA, 27 nt, Artificial Sequence
  Synthetic oligonucleotide
augcauaucuugugcauaaauguugua

SEQ ID NO: 911 - RNA, 27 nt, Artificial Sequence
  Synthetic oligonucleotide
ugcauaucuugugcauaaauguuguac

SEQ ID NO: 912 - RNA, 27 nt, Artificial Sequence
  Synthetic oligonucleotide
gcauaucuugugcauaaauguuguaca

SEQ ID NO: 913 - RNA, 27 nt, Artificial Sequence
  Synthetic oligonucleotide
auaucuugugcauaaauguuguacagg

SEQ ID NO: 914 - RNA, 27 nt, Artificial Sequence
  Synthetic oligonucleotide
uaucuugugcauaaauguuguacagga

SEQ ID NO: 915 - RNA, 27 nt, Artificial Sequence
  Synthetic oligonucleotide
ucuugugcauaaauguuguacaggaua

SEQ ID NO: 916 - RNA, 27 nt, Artificial Sequence
  Synthetic oligonucleotide
cuugugcauaaauguuguacaggauau

SEQ ID NO: 917 - RNA, 27 nt, Artificial Sequence
  Synthetic oligonucleotide
uugugcauaaauguuguacaggauauu

SEQ ID NO: 918 - RNA, 27 nt, Artificial Sequence
  Synthetic oligonucleotide
ugugcauaaauguuguacaggauauuu

SEQ ID NO: 919 - RNA, 27 nt, Artificial Sequence
  Synthetic oligonucleotide
gugcauaaauguuguacaggauauuuu

SEQ ID NO: 920 - RNA, 27 nt, Artificial Sequence
  Synthetic oligonucleotide
ugcauaaauguuguacaggauauuuua

SEQ ID NO: 921 - RNA, 27 nt, Artificial Sequence
  Synthetic oligonucleotide
gcauaaauguuguacaggauauuuuau

SEQ ID NO: 922 - RNA, 27 nt, Artificial Sequence
  Synthetic oligonucleotide
cauaaauguuguacaggauauuuuaua

SEQ ID NO: 923 - RNA, 27 nt, Artificial Sequence
  Synthetic oligonucleotide
auaaauguuguacaggauauuuuauau

SEQ ID NO: 924 - RNA, 27 nt, Artificial Sequence
  Synthetic oligonucleotide
uaaauguuguacaggauauuuuauaua

SEQ ID NO: 925 - RNA, 27 nt, Artificial Sequence
  Synthetic oligonucleotide
aaauguuguacaggauauuuuauauau

SEQ ID NO: 926 - RNA, 27 nt, Artificial Sequence
  Synthetic oligonucleotide
aauguuguacaggauauuuuauauauu

SEQ ID NO: 927 - RNA, 27 nt, Artificial Sequence
  Synthetic oligonucleotide
auguuguacaggauauuuuauauauua

SEQ ID NO: 928 - RNA, 27 nt, Artificial Sequence
  Synthetic oligonucleotide
uguuguacaggauauuuuauauauuau

SEQ ID NO: 929 - RNA, 27 nt, Artificial Sequence
  Synthetic oligonucleotide
gugucuguagugugcauugcaauauua

SEQ ID NO: 930 - RNA, 27 nt, Artificial Sequence
  Synthetic oligonucleotide
cuguagugugcauugcaauauuaugug

SEQ ID NO: 931 - RNA, 27 nt, Artificial Sequence
  Synthetic oligonucleotide
uguagugugcauugcaauauuauguga

SEQ ID NO: 932 - RNA, 27 nt, Artificial Sequence
  Synthetic oligonucleotide
uagugugcauugcaauauuaugugaga

SEQ ID NO: 933 - RNA, 27 nt, Artificial Sequence
  Synthetic oligonucleotide
ugcauugcaauauuaugugagauguaa

SEQ ID NO: 934 - RNA, 27 nt, Artificial Sequence
  Synthetic oligonucleotide
gcauugcaauauuaugugagauguaag

SEQ ID NO: 935 - RNA, 27 nt, Artificial Sequence
  Synthetic oligonucleotide
uugcaauauuaugugagauguaagauc

SEQ ID NO: 936 - RNA, 27 nt, Artificial Sequence
  Synthetic oligonucleotide
ugcaauauuaugugagauguaagaucu

SEQ ID NO: 937 - RNA, 19 nt, Artificial Sequence
  Synthetic oligonucleotide
caaggaccagcugauugug

SEQ ID NO: 938 - RNA, 19 nt, Artificial Sequence
  Synthetic oligonucleotide
aaggaccagcugauuguga

SEQ ID NO: 939 - RNA, 19 nt, Artificial Sequence
  Synthetic oligonucleotide
accagcugauugugaaucu

SEQ ID NO: 940 - RNA, 19 nt, Artificial Sequence
  Synthetic oligonucleotide
gcugauugugaaucuucuu

SEQ ID NO: 941 - RNA, 19 nt, Artificial Sequence
  Synthetic oligonucleotide
cuugugccaucaguaucuu

SEQ ID NO: 942 - RNA, 19 nt, Artificial Sequence
  Synthetic oligonucleotide
cccuuguugacgucaugga

SEQ ID NO: 943 - RNA, 19 nt, Artificial Sequence
  Synthetic oligonucleotide
guugacgucauggaagaca

SEQ ID NO: 944 - RNA, 19 nt, Artificial Sequence
  Synthetic oligonucleotide
uugacgucauggaagacaa

SEQ ID NO: 945 - RNA, 19 nt, Artificial Sequence
  Synthetic oligonucleotide
auugucuccagcaaagacu

SEQ ID NO: 946 - RNA, 19 nt, Artificial Sequence
  Synthetic oligonucleotide
cgaaacgugaacaucuuca

SEQ ID NO: 947 - RNA, 19 nt, Artificial Sequence
  Synthetic oligonucleotide
cgugaacaucuucaaguuc

SEQ ID NO: 948 - RNA, 19 nt, Artificial Sequence
  Synthetic oligonucleotide
gugaacaucuucaaguuca

SEQ ID NO: 949 - RNA, 19 nt, Artificial Sequence
  Synthetic oligonucleotide
ccgaguaauuggaaguggu

SEQ ID NO: 950 - RNA, 19 nt, Artificial Sequence
  Synthetic oligonucleotide
acgaggugaucaagcugaa

SEQ ID NO: 951 - RNA, 19 nt, Artificial Sequence
  Synthetic oligonucleotide
gcugagagcauaaugaaga

SEQ ID NO: 952 - RNA, 19 nt, Artificial Sequence
  Synthetic oligonucleotide
gauuaagggucucuaugga

SEQ ID NO: 953 - RNA, 19 nt, Artificial Sequence
  Synthetic oligonucleotide
aaaauggaaucucggaugu

SEQ ID NO: 954 - RNA, 19 nt, Artificial Sequence
  Synthetic oligonucleotide
ggaaucucggauguuguga

SEQ ID NO: 955 - RNA, 19 nt, Artificial Sequence
  Synthetic oligonucleotide
cggauguugugaaggugac

SEQ ID NO: 956 - RNA, 19 nt, Artificial Sequence
  Synthetic oligonucleotide
gaugcauaucuugugcaua

SEQ ID NO: 957 - RNA, 19 nt, Artificial Sequence
  Synthetic oligonucleotide
augcauaucuugugcauaa

SEQ ID NO: 958 - RNA, 19 nt, Artificial Sequence
  Synthetic oligonucleotide
gcauaucuugugcauaaau

SEQ ID NO: 959 - RNA, 19 nt, Artificial Sequence
  Synthetic oligonucleotide
cauaucuugugcauaaaug

SEQ ID NO: 960 - RNA, 19 nt, Artificial Sequence
  Synthetic oligonucleotide
auaucuugugcauaaaugu

SEQ ID NO: 961 - RNA, 19 nt, Artificial Sequence
  Synthetic oligonucleotide
aucuugugcauaaauguug

SEQ ID NO: 962 - RNA, 19 nt, Artificial Sequence
  Synthetic oligonucleotide
ucuugugcauaaauguugu

SEQ ID NO: 963 - RNA, 19 nt, Artificial Sequence
  Synthetic oligonucleotide
uugugcauaaauguuguac

SEQ ID NO: 964 - RNA, 19 nt, Artificial Sequence
  Synthetic oligonucleotide
ugugcauaaauguuguaca

SEQ ID NO: 965 - RNA, 19 nt, Artificial Sequence
  Synthetic oligonucleotide
gugcauaaauguuguacag

SEQ ID NO: 966 - RNA, 19 nt, Artificial Sequence
  Synthetic oligonucleotide
ugcauaaauguuguacagg

SEQ ID NO: 967 - RNA, 19 nt, Artificial Sequence
  Synthetic oligonucleotide
gcauaaauguuguacagga

SEQ ID NO: 968 - RNA, 19 nt, Artificial Sequence
  Synthetic oligonucleotide
cauaaauguuguacaggau

SEQ ID NO: 969 - RNA, 19 nt, Artificial Sequence
  Synthetic oligonucleotide
auaaauguuguacaggaua

SEQ ID NO: 970 - RNA, 19 nt, Artificial Sequence
  Synthetic oligonucleotide
uaaauguuguacaggauau

SEQ ID NO: 971 - RNA, 19 nt, Artificial Sequence
  Synthetic oligonucleotide
aaauguuguacaggauauu

SEQ ID NO: 972 - RNA, 19 nt, Artificial Sequence
  Synthetic oligonucleotide
aauguuguacaggauauuu

SEQ ID NO: 973 - RNA, 19 nt, Artificial Sequence
  Synthetic oligonucleotide
auguuguacaggauauuuu

SEQ ID NO: 974 - RNA, 19 nt, Artificial Sequence
  Synthetic oligonucleotide
uguuguacaggauauuuua

SEQ ID NO: 975 - RNA, 19 nt, Artificial Sequence
  Synthetic oligonucleotide
guuguacaggauauuuuau

SEQ ID NO: 976 - RNA, 19 nt, Artificial Sequence
  Synthetic oligonucleotide
uuguacaggauauuuuaua

SEQ ID NO: 977 - RNA, 19 nt, Artificial Sequence
  Synthetic oligonucleotide
gucuguagugugcauugca

SEQ ID NO: 978 - RNA, 19 nt, Artificial Sequence
  Synthetic oligonucleotide
guagugugcauugcaauau

SEQ ID NO: 979 - RNA, 19 nt, Artificial Sequence
  Synthetic oligonucleotide
uagugugcauugcaauauu

SEQ ID NO: 980 - RNA, 19 nt, Artificial Sequence
  Synthetic oligonucleotide
gugugcauugcaauauuau

SEQ ID NO: 981 - RNA, 19 nt, Artificial Sequence
  Synthetic oligonucleotide
cauugcaauauuaugugag

SEQ ID NO: 982 - RNA, 19 nt, Artificial Sequence
  Synthetic oligonucleotide
auugcaauauuaugugaga

SEQ ID NO: 983 - RNA, 19 nt, Artificial Sequence
  Synthetic oligonucleotide
gcaauauuaugugagaugu

SEQ ID NO: 984 - RNA, 19 nt, Artificial Sequence
  Synthetic oligonucleotide
caauauuaugugagaugua

SEQ ID NO: 985 - RNA, 19 nt, Artificial Sequence
  Synthetic oligonucleotide
ucaaggaccagcugauugu

SEQ ID NO: 986 - RNA, 19 nt, Artificial Sequence
  Synthetic oligonucleotide
caaggaccagcugauugug

SEQ ID NO: 987 - RNA, 19 nt, Artificial Sequence
  Synthetic oligonucleotide
gaccagcugauugugaauc

SEQ ID NO: 988 - RNA, 19 nt, Artificial Sequence
  Synthetic oligonucleotide
agcugauugugaaucuucu

SEQ ID NO: 989 - RNA, 19 nt, Artificial Sequence
  Synthetic oligonucleotide
gcuugugccaucaguaucu

SEQ ID NO: 990 - RNA, 19 nt, Artificial Sequence
  Synthetic oligonucleotide
gcccuuguugacgucaugg

SEQ ID NO: 991 - RNA, 19 nt, Artificial Sequence
  Synthetic oligonucleotide
uguugacgucauggaagac

SEQ ID NO: 992 - RNA, 19 nt, Artificial Sequence
  Synthetic oligonucleotide
guugacgucauggaagaca

SEQ ID NO: 993 - RNA, 19 nt, Artificial Sequence
  Synthetic oligonucleotide
aauugucuccagcaaagac

SEQ ID NO: 994 - RNA, 19 nt, Artificial Sequence
  Synthetic oligonucleotide
gcgaaacgugaacaucuuc

SEQ ID NO: 995 - RNA, 19 nt, Artificial Sequence
  Synthetic oligonucleotide
acgugaacaucuucaaguu

SEQ ID NO: 996 - RNA, 19 nt, Artificial Sequence
  Synthetic oligonucleotide
cgugaacaucuucaaguuc

SEQ ID NO: 997 - RNA, 19 nt, Artificial Sequence
  Synthetic oligonucleotide
accgaguaauuggaagugg

SEQ ID NO: 998 - RNA, 19 nt, Artificial Sequence
  Synthetic oligonucleotide
uacgaggugaucaagcuga

SEQ ID NO: 999 - RNA, 19 nt, Artificial Sequence
  Synthetic oligonucleotide
ggcugagagcauaaugaag

SEQ ID NO: 1000 - RNA, 19 nt, Artificial Sequence
  Synthetic oligonucleotide
ugauuaagggucucuaugg

SEQ ID NO: 1001 - RNA, 19 nt, Artificial Sequence
  Synthetic oligonucleotide
caaaauggaaucucggaug

SEQ ID NO: 1002 - RNA, 19 nt, Artificial Sequence
  Synthetic oligonucleotide
uggaaucucggauguugug

SEQ ID NO: 1003 - RNA, 19 nt, Artificial Sequence
  Synthetic oligonucleotide
ucggauguugugaagguga

SEQ ID NO: 1004 - RNA, 19 nt, Artificial Sequence
  Synthetic oligonucleotide
ugaugcauaucuugugcau

SEQ ID NO: 1005 - RNA, 19 nt, Artificial Sequence
  Synthetic oligonucleotide
gaugcauaucuugugcaua

SEQ ID NO: 1006 - RNA, 19 nt, Artificial Sequence
  Synthetic oligonucleotide
ugcauaucuugugcauaaa

SEQ ID NO: 1007 - RNA, 19 nt, Artificial Sequence
  Synthetic oligonucleotide
gcauaucuugugcauaaau

SEQ ID NO: 1008 - RNA, 19 nt, Artificial Sequence
  Synthetic oligonucleotide
cauaucuugugcauaaaug

SEQ ID NO: 1009 - RNA, 19 nt, Artificial Sequence
  Synthetic oligonucleotide
uaucuugugcauaaauguu

SEQ ID NO: 1010 - RNA, 19 nt, Artificial Sequence
  Synthetic oligonucleotide
aucuugugcauaaauguug

SEQ ID NO: 1011 - RNA, 19 nt, Artificial Sequence
  Synthetic oligonucleotide
cuugugcauaaauguugua

SEQ ID NO: 1012 - RNA, 19 nt, Artificial Sequence
  Synthetic oligonucleotide
uugugcauaaauguuguac

SEQ ID NO: 1013 - RNA, 19 nt, Artificial Sequence
  Synthetic oligonucleotide
ugugcauaaauguuguaca

SEQ ID NO: 1014 - RNA, 19 nt, Artificial Sequence
  Synthetic oligonucleotide
gugcauaaauguuguacag

SEQ ID NO: 1015 - RNA, 19 nt, Artificial Sequence
  Synthetic oligonucleotide
ugcauaaauguuguacagg

SEQ ID NO: 1016 - RNA, 19 nt, Artificial Sequence
  Synthetic oligonucleotide
gcauaaauguuguacagga

SEQ ID NO: 1017 - RNA, 19 nt, Artificial Sequence
  Synthetic oligonucleotide
cauaaauguuguacaggau

SEQ ID NO: 1018 - RNA, 19 nt, Artificial Sequence
  Synthetic oligonucleotide
auaaauguuguacaggaua

SEQ ID NO: 1019 - RNA, 19 nt, Artificial Sequence
  Synthetic oligonucleotide
uaaauguuguacaggauau

SEQ ID NO: 1020 - RNA, 19 nt, Artificial Sequence
  Synthetic oligonucleotide
aaauguuguacaggauauu

SEQ ID NO: 1021 - RNA, 19 nt, Artificial Sequence
  Synthetic oligonucleotide
aauguuguacaggauauuu

SEQ ID NO: 1022 - RNA, 19 nt, Artificial Sequence
  Synthetic oligonucleotide
auguuguacaggauauuuu

SEQ ID NO: 1023 - RNA, 19 nt, Artificial Sequence
  Synthetic oligonucleotide
uguuguacaggauauuuua

SEQ ID NO: 1024 - RNA, 19 nt, Artificial Sequence
  Synthetic oligonucleotide
guuguacaggauauuuuau

SEQ ID NO: 1025 - RNA, 19 nt, Artificial Sequence
  Synthetic oligonucleotide
ugucuguagugugcauugc

SEQ ID NO: 1026 - RNA, 19 nt, Artificial Sequence
  Synthetic oligonucleotide
uguagugugcauugcaaua

SEQ ID NO: 1027 - RNA, 19 nt, Artificial Sequence
  Synthetic oligonucleotide
guagugugcauugcaauau

SEQ ID NO: 1028 - RNA, 19 nt, Artificial Sequence
  Synthetic oligonucleotide
agugugcauugcaauauua

SEQ ID NO: 1029 - RNA, 19 nt, Artificial Sequence
  Synthetic oligonucleotide
gcauugcaauauuauguga

SEQ ID NO: 1030 - RNA, 19 nt, Artificial Sequence
  Synthetic oligonucleotide
cauugcaauauuaugugag

SEQ ID NO: 1031 - RNA, 19 nt, Artificial Sequence
  Synthetic oligonucleotide
ugcaauauuaugugagaug

SEQ ID NO: 1032 - RNA, 19 nt, Artificial Sequence
  Synthetic oligonucleotide
gcaauauuaugugagaugu

SEQ ID NO: 1033 - RNA, 19 nt, Artificial Sequence
  Synthetic oligonucleotide
cucaaggaccagcugauug

SEQ ID NO: 1034 - RNA, 19 nt, Artificial Sequence
  Synthetic oligonucleotide
ucaaggaccagcugauugu

SEQ ID NO: 1035 - RNA, 19 nt, Artificial Sequence
  Synthetic oligonucleotide
ggaccagcugauugugaau

SEQ ID NO: 1036 - RNA, 19 nt, Artificial Sequence
  Synthetic oligonucleotide
cagcugauugugaaucuuc

SEQ ID NO: 1037 - RNA, 19 nt, Artificial Sequence
  Synthetic oligonucleotide
ggcuugugccaucaguauc

SEQ ID NO: 1038 - RNA, 19 nt, Artificial Sequence
  Synthetic oligonucleotide
ugcccuuguugacgucaug

SEQ ID NO: 1039 - RNA, 19 nt, Artificial Sequence
  Synthetic oligonucleotide
uuguugacgucauggaaga

SEQ ID NO: 1040 - RNA, 19 nt, Artificial Sequence
  Synthetic oligonucleotide
uguugacgucauggaagac

SEQ ID NO: 1041 - RNA, 19 nt, Artificial Sequence
  Synthetic oligonucleotide
aaauugucuccagcaaaga

SEQ ID NO: 1042 - RNA, 19 nt, Artificial Sequence
  Synthetic oligonucleotide
agcgaaacgugaacaucuu

SEQ ID NO: 1043 - RNA, 19 nt, Artificial Sequence
  Synthetic oligonucleotide
aacgugaacaucuucaagu

SEQ ID NO: 1044 - RNA, 19 nt, Artificial Sequence
  Synthetic oligonucleotide
acgugaacaucuucaaguu

SEQ ID NO: 1045 - RNA, 19 nt, Artificial Sequence
  Synthetic oligonucleotide
aaccgaguaauuggaagug

SEQ ID NO: 1046 - RNA, 19 nt, Artificial Sequence
  Synthetic oligonucleotide
cuacgaggugaucaagcug

SEQ ID NO: 1047 - RNA, 19 nt, Artificial Sequence
  Synthetic oligonucleotide
uggcugagagcauaaugaa

SEQ ID NO: 1048 - RNA, 19 nt, Artificial Sequence
  Synthetic oligonucleotide
augauuaagggucucuaug

SEQ ID NO: 1049 - RNA, 19 nt, Artificial Sequence
  Synthetic oligonucleotide
acaaaauggaaucucggau

SEQ ID NO: 1050 - RNA, 19 nt, Artificial Sequence
  Synthetic oligonucleotide
auggaaucucggauguugu

SEQ ID NO: 1051 - RNA, 19 nt, Artificial Sequence
  Synthetic oligonucleotide
cucggauguugugaaggug

SEQ ID NO: 1052 - RNA, 19 nt, Artificial Sequence
  Synthetic oligonucleotide
augaugcauaucuugugca

SEQ ID NO: 1053 - RNA, 19 nt, Artificial Sequence
  Synthetic oligonucleotide
ugaugcauaucuugugcau

SEQ ID NO: 1054 - RNA, 19 nt, Artificial Sequence
  Synthetic oligonucleotide
augcauaucuugugcauaa

SEQ ID NO: 1055 - RNA, 19 nt, Artificial Sequence
  Synthetic oligonucleotide
ugcauaucuugugcauaaa

SEQ ID NO: 1056 - RNA, 19 nt, Artificial Sequence
  Synthetic oligonucleotide
gcauaucuugugcauaaau

SEQ ID NO: 1057 - RNA, 19 nt, Artificial Sequence
  Synthetic oligonucleotide
auaucuugugcauaaaugu

SEQ ID NO: 1058 - RNA, 19 nt, Artificial Sequence
  Synthetic oligonucleotide
uaucuugugcauaaauguu

SEQ ID NO: 1059 - RNA, 19 nt, Artificial Sequence
  Synthetic oligonucleotide
ucuugugcauaaauguugu

SEQ ID NO: 1060 - RNA, 19 nt, Artificial Sequence
  Synthetic oligonucleotide
cuugugcauaaauguugua

SEQ ID NO: 1061 - RNA, 19 nt, Artificial Sequence
  Synthetic oligonucleotide
uugugcauaaauguuguac

SEQ ID NO: 1062 - RNA, 19 nt, Artificial Sequence
  Synthetic oligonucleotide
ugugcauaaauguuguaca

SEQ ID NO: 1063 - RNA, 19 nt, Artificial Sequence
  Synthetic oligonucleotide
gugcauaaauguuguacag

SEQ ID NO: 1064 - RNA, 19 nt, Artificial Sequence
  Synthetic oligonucleotide
ugcauaaauguuguacagg

SEQ ID NO: 1065 - RNA, 19 nt, Artificial Sequence
  Synthetic oligonucleotide
gcauaaauguuguacagga

SEQ ID NO: 1066 - RNA, 19 nt, Artificial Sequence
  Synthetic oligonucleotide
cauaaauguuguacaggau

SEQ ID NO: 1067 - RNA, 19 nt, Artificial Sequence
  Synthetic oligonucleotide
auaaauguuguacaggaua

SEQ ID NO: 1068 - RNA, 19 nt, Artificial Sequence
  Synthetic oligonucleotide
uaaauguuguacaggauau

SEQ ID NO: 1069 - RNA, 19 nt, Artificial Sequence
  Synthetic oligonucleotide
aaauguuguacaggauauu

SEQ ID NO: 1070 - RNA, 19 nt, Artificial Sequence
  Synthetic oligonucleotide
aauguuguacaggauauuu

SEQ ID NO: 1071 - RNA, 19 nt, Artificial Sequence
  Synthetic oligonucleotide
auguuguacaggauauuuu

SEQ ID NO: 1072 - RNA, 19 nt, Artificial Sequence
  Synthetic oligonucleotide
uguuguacaggauauuuua

SEQ ID NO: 1073 - RNA, 19 nt, Artificial Sequence
  Synthetic oligonucleotide
gugucuguagugugcauug

SEQ ID NO: 1074 - RNA, 19 nt, Artificial Sequence
  Synthetic oligonucleotide
cuguagugugcauugcaau

SEQ ID NO: 1075 - RNA, 19 nt, Artificial Sequence
  Synthetic oligonucleotide
uguagugugcauugcaaua

SEQ ID NO: 1076 - RNA, 19 nt, Artificial Sequence
  Synthetic oligonucleotide
uagugugcauugcaauauu

SEQ ID NO: 1077 - RNA, 19 nt, Artificial Sequence
  Synthetic oligonucleotide
ugcauugcaauauuaugug

SEQ ID NO: 1078 - RNA, 19 nt, Artificial Sequence
  Synthetic oligonucleotide
gcauugcaauauuauguga

SEQ ID NO: 1079 - RNA, 19 nt, Artificial Sequence
  Synthetic oligonucleotide
uugcaauauuaugugagau

SEQ ID NO: 1080 - RNA, 19 nt, Artificial Sequence
  Synthetic oligonucleotide
ugcaauauuaugugagaug

SEQ ID NO: 1081 - DNA, 25 bp, Artificial Sequence
  Synthetic oligonucleotide
cugccggucgguugucuggcugcgc

SEQ ID NO: 1082 - DNA, 25 bp, Artificial Sequence
  Synthetic oligonucleotide
ugccggucgguugucuggcugcgcg

SEQ ID NO: 1083 - DNA, 25 bp, Artificial Sequence
  Synthetic oligonucleotide
gccggucgguugucuggcugcgcgc

SEQ ID NO: 1084 - DNA, 25 bp, Artificial Sequence
  Synthetic oligonucleotide
gucgguugucuggcugcgcgcgcca

SEQ ID NO: 1085 - DNA, 25 bp, Artificial Sequence
  Synthetic oligonucleotide
gugccccgccuggcucggcauccac

SEQ ID NO: 1086 - DNA, 25 bp, Artificial Sequence
  Synthetic oligonucleotide
ccgccuggcucggcauccaccccca

SEQ ID NO: 1087 - DNA, 25 bp, Artificial Sequence
  Synthetic oligonucleotide
cgccuggcucggcauccacccccag

SEQ ID NO: 1088 - DNA, 25 bp, Artificial Sequence
  Synthetic oligonucleotide
ccuggcucggcauccacccccagcc

SEQ ID NO: 1089 - DNA, 25 bp, Artificial Sequence
  Synthetic oligonucleotide
uggcucggcauccacccccagcccg

SEQ ID NO: 1090 - DNA, 25 bp, Artificial Sequence
  Synthetic oligonucleotide
ggcucggcauccacccccagcccga

SEQ ID NO: 1091 - DNA, 25 bp, Artificial Sequence
  Synthetic oligonucleotide
gcucggcauccacccccagcccgac

SEQ ID NO: 1092 - DNA, 25 bp, Artificial Sequence
  Synthetic oligonucleotide
cucggcauccacccccagcccgact

SEQ ID NO: 1093 - DNA, 25 bp, Artificial Sequence
  Synthetic oligonucleotide
ucggcauccacccccagcccgactc

SEQ ID NO: 1094 - DNA, 25 bp, Artificial Sequence
  Synthetic oligonucleotide
cggcauccacccccagcccgacuca

SEQ ID NO: 1095 - DNA, 25 bp, Artificial Sequence
  Synthetic oligonucleotide
ggcauccacccccagcccgacucac

SEQ ID NO: 1096 - DNA, 25 bp, Artificial Sequence
  Synthetic oligonucleotide
gcauccacccccagcccgacucaca

SEQ ID NO: 1097 - DNA, 25 bp, Artificial Sequence
  Synthetic oligonucleotide
cauccacccccagcccgacucacac

SEQ ID NO: 1098 - DNA, 25 bp, Artificial Sequence
  Synthetic oligonucleotide
auccacccccagcccgacucacacg

SEQ ID NO: 1099 - DNA, 25 bp, Artificial Sequence
  Synthetic oligonucleotide
uccacccccagcccgacucacacgt

SEQ ID NO: 1100 - DNA, 25 bp, Artificial Sequence
  Synthetic oligonucleotide
ccacccccagcccgacucacacgtg

SEQ ID NO: 1101 - DNA, 25 bp, Artificial Sequence
  Synthetic oligonucleotide
cacccccagcccgacucacacgugg

SEQ ID NO: 1102 - DNA, 25 bp, Artificial Sequence
  Synthetic oligonucleotide
acccccagcccgacucacacguggg

SEQ ID NO: 1103 - DNA, 25 bp, Artificial Sequence
  Synthetic oligonucleotide
cccccagcccgacucacacgugggt

SEQ ID NO: 1104 - DNA, 25 bp, Artificial Sequence
  Synthetic oligonucleotide
ccccagcccgacucacacgugggtt

SEQ ID NO: 1105 - DNA, 25 bp, Artificial Sequence
  Synthetic oligonucleotide
cccagcccgacucacacgugggutc

SEQ ID NO: 1106 - DNA, 25 bp, Artificial Sequence
  Synthetic oligonucleotide
ccagcccgacucacacguggguucc

SEQ ID NO: 1107 - DNA, 25 bp, Artificial Sequence
  Synthetic oligonucleotide
cagcccgacucacacguggguuccc

SEQ ID NO: 1108 - DNA, 25 bp, Artificial Sequence
  Synthetic oligonucleotide
agcccgacucacacguggguucccg

SEQ ID NO: 1109 - DNA, 25 bp, Artificial Sequence
  Synthetic oligonucleotide
gcccgacucacacguggguucccgc

SEQ ID NO: 1110 - DNA, 25 bp, Artificial Sequence
  Synthetic oligonucleotide
cccgacucacacguggguucccgca

SEQ ID NO: 1111 - DNA, 25 bp, Artificial Sequence
  Synthetic oligonucleotide
ccgacucacacguggguucccgcac

SEQ ID NO: 1112 - DNA, 25 bp, Artificial Sequence
  Synthetic oligonucleotide
cgacucacacguggguucccgcacg

SEQ ID NO: 1113 - DNA, 25 bp, Artificial Sequence
  Synthetic oligonucleotide
gacucacacguggguucccgcacgt

SEQ ID NO: 1114 - DNA, 25 bp, Artificial Sequence
  Synthetic oligonucleotide
acucacacguggguucccgcacgtc

SEQ ID NO: 1115 - DNA, 25 bp, Artificial Sequence
  Synthetic oligonucleotide
cucacacguggguucccgcacgucc

SEQ ID NO: 1116 - DNA, 25 bp, Artificial Sequence
  Synthetic oligonucleotide
ucacacguggguucccgcacguccg

SEQ ID NO: 1117 - DNA, 25 bp, Artificial Sequence
  Synthetic oligonucleotide
cacacguggguucccgcacguccgc

SEQ ID NO: 1118 - DNA, 25 bp, Artificial Sequence
  Synthetic oligonucleotide
acacguggguucccgcacguccgcc

SEQ ID NO: 1119 - DNA, 25 bp, Artificial Sequence
  Synthetic oligonucleotide
cacguggguucccgcacguccgccg

SEQ ID NO: 1120 - DNA, 25 bp, Artificial Sequence
  Synthetic oligonucleotide
cggccccccccgcugacgucagcat

SEQ ID NO: 1121 - DNA, 25 bp, Artificial Sequence
  Synthetic oligonucleotide
ggccccccccgcugacgucagcata

SEQ ID NO: 1122 - DNA, 25 bp, Artificial Sequence
  Synthetic oligonucleotide
gccccccccgcugacgucagcauag

SEQ ID NO: 1123 - DNA, 25 bp, Artificial Sequence
  Synthetic oligonucleotide
ccccccccgcugacgucagcauagc

SEQ ID NO: 1124 - DNA, 25 bp, Artificial Sequence
  Synthetic oligonucleotide
cccccccgcugacgucagcauagct

SEQ ID NO: 1125 - DNA, 25 bp, Artificial Sequence
  Synthetic oligonucleotide
ccccccgcugacgucagcauagctg

SEQ ID NO: 1126 - DNA, 25 bp, Artificial Sequence
  Synthetic oligonucleotide
cccccgcugacgucagcauagcugt

SEQ ID NO: 1127 - DNA, 25 bp, Artificial Sequence
  Synthetic oligonucleotide
ccccgcugacgucagcauagcugtt

SEQ ID NO: 1128 - DNA, 25 bp, Artificial Sequence
  Synthetic oligonucleotide
cccgcugacgucagcauagcugutc

SEQ ID NO: 1129 - DNA, 25 bp, Artificial Sequence
  Synthetic oligonucleotide
ccgcugacgucagcauagcuguucc

SEQ ID NO: 1130 - DNA, 25 bp, Artificial Sequence
  Synthetic oligonucleotide
cgcugacgucagcauagcuguucca

SEQ ID NO: 1131 - DNA, 25 bp, Artificial Sequence
  Synthetic oligonucleotide
gcugacgucagcauagcuguuccac

SEQ ID NO: 1132 - DNA, 25 bp, Artificial Sequence
  Synthetic oligonucleotide
cugacgucagcauagcuguuccact

SEQ ID NO: 1133 - DNA, 25 bp, Artificial Sequence
  Synthetic oligonucleotide
ugacgucagcauagcuguuccactt

SEQ ID NO: 1134 - DNA, 25 bp, Artificial Sequence
  Synthetic oligonucleotide
gacgucagcauagcuguuccacuta

SEQ ID NO: 1135 - DNA, 25 bp, Artificial Sequence
  Synthetic oligonucleotide
acgucagcauagcuguuccacuuaa

SEQ ID NO: 1136 - DNA, 25 bp, Artificial Sequence
  Synthetic oligonucleotide
cgucagcauagcuguuccacuuaag

SEQ ID NO: 1137 - DNA, 25 bp, Artificial Sequence
  Synthetic oligonucleotide
gucagcauagcuguuccacuuaagg

SEQ ID NO: 1138 - DNA, 25 bp, Artificial Sequence
  Synthetic oligonucleotide
ucagcauagcuguuccacuuaaggc

SEQ ID NO: 1139 - DNA, 25 bp, Artificial Sequence
  Synthetic oligonucleotide
cagcauagcuguuccacuuaaggcc

SEQ ID NO: 1140 - DNA, 25 bp, Artificial Sequence
  Synthetic oligonucleotide
agcauagcuguuccacuuaaggccc

SEQ ID NO: 1141 - DNA, 25 bp, Artificial Sequence
  Synthetic oligonucleotide
gcauagcuguuccacuuaaggcccc

SEQ ID NO: 1142 - DNA, 25 bp, Artificial Sequence
  Synthetic oligonucleotide
cauagcuguuccacuuaaggcccct

SEQ ID NO: 1143 - DNA, 25 bp, Artificial Sequence
  Synthetic oligonucleotide
auagcuguuccacuuaaggcccctc

SEQ ID NO: 1144 - DNA, 25 bp, Artificial Sequence
  Synthetic oligonucleotide
uagcuguuccacuuaaggccccucc

SEQ ID NO: 1145 - DNA, 25 bp, Artificial Sequence
  Synthetic oligonucleotide
agcuguuccacuuaaggccccuccc

SEQ ID NO: 1146 - DNA, 25 bp, Artificial Sequence
  Synthetic oligonucleotide
gcuguuccacuuaaggccccucccg

SEQ ID NO: 1147 - DNA, 25 bp, Artificial Sequence
  Synthetic oligonucleotide
cuguuccacuuaaggccccucccgc

SEQ ID NO: 1148 - DNA, 25 bp, Artificial Sequence
  Synthetic oligonucleotide
ccucccgcgcccagcucagagugct

SEQ ID NO: 1149 - DNA, 25 bp, Artificial Sequence
  Synthetic oligonucleotide
cccgcgcccagcucagagugcugca

SEQ ID NO: 1150 - DNA, 25 bp, Artificial Sequence
  Synthetic oligonucleotide
ccgcgcccagcucagagugcugcag

SEQ ID NO: 1151 - DNA, 25 bp, Artificial Sequence
  Synthetic oligonucleotide
cgcgcccagcucagagugcugcagc

SEQ ID NO: 1152 - DNA, 25 bp, Artificial Sequence
  Synthetic oligonucleotide
gcgcccagcucagagugcugcagcc

SEQ ID NO: 1153 - DNA, 25 bp, Artificial Sequence
  Synthetic oligonucleotide
gcccagcucagagugcugcagccgc

SEQ ID NO: 1154 - DNA, 25 bp, Artificial Sequence
  Synthetic oligonucleotide
cccagcucagagugcugcagccgct

SEQ ID NO: 1155 - DNA, 25 bp, Artificial Sequence
  Synthetic oligonucleotide
cagcucagagugcugcagccgcugc

SEQ ID NO: 1156 - DNA, 25 bp, Artificial Sequence
  Synthetic oligonucleotide
agcucagagugcugcagccgcugcc

SEQ ID NO: 1157 - DNA, 25 bp, Artificial Sequence
  Synthetic oligonucleotide
gcucagagugcugcagccgcugccg

SEQ ID NO: 1158 - DNA, 25 bp, Artificial Sequence
  Synthetic oligonucleotide
cucagagugcugcagccgcugccgc

SEQ ID NO: 1159 - DNA, 25 bp, Artificial Sequence
  Synthetic oligonucleotide
ccgcugccgccgauuccggaucuca

SEQ ID NO: 1160 - DNA, 25 bp, Artificial Sequence
  Synthetic oligonucleotide
cgcugccgccgauuccggaucucat

SEQ ID NO: 1161 - DNA, 25 bp, Artificial Sequence
  Synthetic oligonucleotide
gcugccgccgauuccggaucucatt

SEQ ID NO: 1162 - DNA, 25 bp, Artificial Sequence
  Synthetic oligonucleotide
cugccgccgauuccggaucucautg

SEQ ID NO: 1163 - DNA, 25 bp, Artificial Sequence
  Synthetic oligonucleotide
ugccgccgauuccggaucucauugc

SEQ ID NO: 1164 - DNA, 25 bp, Artificial Sequence
  Synthetic oligonucleotide
gccgccgauuccggaucucauugcc

SEQ ID NO: 1165 - DNA, 25 bp, Artificial Sequence
  Synthetic oligonucleotide
ccgccgauuccggaucucauugcca

SEQ ID NO: 1166 - DNA, 25 bp, Artificial Sequence
  Synthetic oligonucleotide
cgccgauuccggaucucauugccac

SEQ ID NO: 1167 - DNA, 25 bp, Artificial Sequence
  Synthetic oligonucleotide
gccgauuccggaucucauugccacg

SEQ ID NO: 1168 - DNA, 25 bp, Artificial Sequence
  Synthetic oligonucleotide
ccgauuccggaucucauugccacgc

SEQ ID NO: 1169 - DNA, 25 bp, Artificial Sequence
  Synthetic oligonucleotide
cgauuccggaucucauugccacgcg

SEQ ID NO: 1170 - DNA, 25 bp, Artificial Sequence
  Synthetic oligonucleotide
gauuccggaucucauugccacgcgc

SEQ ID NO: 1171 - DNA, 25 bp, Artificial Sequence
  Synthetic oligonucleotide
auuccggaucucauugccacgcgcc

SEQ ID NO: 1172 - DNA, 25 bp, Artificial Sequence
  Synthetic oligonucleotide
uuccggaucucauugccacgcgccc

SEQ ID NO: 1173 - DNA, 25 bp, Artificial Sequence
  Synthetic oligonucleotide
uccggaucucauugccacgcgcccc

SEQ ID NO: 1174 - DNA, 25 bp, Artificial Sequence
  Synthetic oligonucleotide
ccggaucucauugccacgcgccccc

SEQ ID NO: 1175 - DNA, 25 bp, Artificial Sequence
  Synthetic oligonucleotide
cggaucucauugccacgcgcccccg

SEQ ID NO: 1176 - DNA, 25 bp, Artificial Sequence
  Synthetic oligonucleotide
ggaucucauugccacgcgcccccga

SEQ ID NO: 1177 - DNA, 25 bp, Artificial Sequence
  Synthetic oligonucleotide
gaucucauugccacgcgcccccgac

SEQ ID NO: 1178 - DNA, 25 bp, Artificial Sequence
  Synthetic oligonucleotide
aucucauugccacgcgcccccgacg

SEQ ID NO: 1179 - DNA, 25 bp, Artificial Sequence
  Synthetic oligonucleotide
ucucauugccacgcgcccccgacga

SEQ ID NO: 1180 - DNA, 25 bp, Artificial Sequence
  Synthetic oligonucleotide
cucauugccacgcgcccccgacgac

SEQ ID NO: 1181 - DNA, 25 bp, Artificial Sequence
  Synthetic oligonucleotide
ucauugccacgcgcccccgacgacc

SEQ ID NO: 1182 - DNA, 25 bp, Artificial Sequence
  Synthetic oligonucleotide
cauugccacgcgcccccgacgaccg

SEQ ID NO: 1183 - DNA, 25 bp, Artificial Sequence
  Synthetic oligonucleotide
auugccacgcgcccccgacgaccgc

SEQ ID NO: 1184 - DNA, 25 bp, Artificial Sequence
  Synthetic oligonucleotide
ccccgacgaccgcccgacgugcatt

SEQ ID NO: 1185 - DNA, 25 bp, Artificial Sequence
  Synthetic oligonucleotide
cccgacgaccgcccgacgugcautc

SEQ ID NO: 1186 - DNA, 25 bp, Artificial Sequence
  Synthetic oligonucleotide
ccgacgaccgcccgacgugcauucc

SEQ ID NO: 1187 - DNA, 25 bp, Artificial Sequence
  Synthetic oligonucleotide
cgacgaccgcccgacgugcauuccc

SEQ ID NO: 1188 - DNA, 25 bp, Artificial Sequence
  Synthetic oligonucleotide
gacgaccgcccgacgugcauucccg

SEQ ID NO: 1189 - DNA, 25 bp, Artificial Sequence
  Synthetic oligonucleotide
acgaccgcccgacgugcauucccga

SEQ ID NO: 1190 - DNA, 25 bp, Artificial Sequence
  Synthetic oligonucleotide
cgaccgcccgacgugcauucccgat

SEQ ID NO: 1191 - DNA, 25 bp, Artificial Sequence
  Synthetic oligonucleotide
gaccgcccgacgugcauucccgatt

SEQ ID NO: 1192 - DNA, 25 bp, Artificial Sequence
  Synthetic oligonucleotide
accgcccgacgugcauucccgautc

SEQ ID NO: 1193 - DNA, 25 bp, Artificial Sequence
  Synthetic oligonucleotide
ccgcccgacgugcauucccgauucc

SEQ ID NO: 1194 - DNA, 25 bp, Artificial Sequence
  Synthetic oligonucleotide
cgcccgacgugcauucccgauucct

SEQ ID NO: 1195 - DNA, 25 bp, Artificial Sequence
  Synthetic oligonucleotide
gcccgacgugcauucccgauucctt

SEQ ID NO: 1196 - DNA, 25 bp, Artificial Sequence
  Synthetic oligonucleotide
cccgacgugcauucccgauuccutt

SEQ ID NO: 1197 - DNA, 25 bp, Artificial Sequence
  Synthetic oligonucleotide
ccgacgugcauucccgauuccuutt

SEQ ID NO: 1198 - DNA, 25 bp, Artificial Sequence
  Synthetic oligonucleotide
cgacgugcauucccgauuccuuutg

SEQ ID NO: 1199 - DNA, 25 bp, Artificial Sequence
  Synthetic oligonucleotide
gacgugcauucccgauuccuuuugg

SEQ ID NO: 1200 - DNA, 25 bp, Artificial Sequence
  Synthetic oligonucleotide
acgugcauucccgauuccuuuuggt

SEQ ID NO: 1201 - DNA, 25 bp, Artificial Sequence
  Synthetic oligonucleotide
cgugcauucccgauuccuuuuggtt

SEQ ID NO: 1202 - DNA, 25 bp, Artificial Sequence
  Synthetic oligonucleotide
gugcauucccgauuccuuuuggutc

SEQ ID NO: 1203 - DNA, 25 bp, Artificial Sequence
  Synthetic oligonucleotide
ugcauucccgauuccuuuugguucc

SEQ ID NO: 1204 - DNA, 25 bp, Artificial Sequence
  Synthetic oligonucleotide
gcauucccgauuccuuuugguucca

SEQ ID NO: 1205 - DNA, 25 bp, Artificial Sequence
  Synthetic oligonucleotide
cauucccgauuccuuuugguuccaa

SEQ ID NO: 1206 - DNA, 25 bp, Artificial Sequence
  Synthetic oligonucleotide
auucccgauuccuuuugguuccaag

SEQ ID NO: 1207 - DNA, 25 bp, Artificial Sequence
  Synthetic oligonucleotide
uucccgauuccuuuugguuccaagt

SEQ ID NO: 1208 - DNA, 25 bp, Artificial Sequence
  Synthetic oligonucleotide
ucccgauuccuuuugguuccaagtc

SEQ ID NO: 1209 - DNA, 25 bp, Artificial Sequence
  Synthetic oligonucleotide
cccgauuccuuuugguuccaagucc

SEQ ID NO: 1210 - DNA, 25 bp, Artificial Sequence
  Synthetic oligonucleotide
ccgauuccuuuugguuccaagucca

SEQ ID NO: 1211 - DNA, 25 bp, Artificial Sequence
  Synthetic oligonucleotide
cgauuccuuuugguuccaaguccaa

SEQ ID NO: 1212 - DNA, 25 bp, Artificial Sequence
  Synthetic oligonucleotide
gauuccuuuugguuccaaguccaat

SEQ ID NO: 1213 - DNA, 25 bp, Artificial Sequence
  Synthetic oligonucleotide
auuccuuuugguuccaaguccaata

SEQ ID NO: 1214 - DNA, 25 bp, Artificial Sequence
  Synthetic oligonucleotide
uuccuuuugguuccaaguccaauat

SEQ ID NO: 1215 - DNA, 25 bp, Artificial Sequence
  Synthetic oligonucleotide
uccuuuugguuccaaguccaauatg

SEQ ID NO: 1216 - DNA, 25 bp, Artificial Sequence
  Synthetic oligonucleotide
ccuuuugguuccaaguccaauaugg

SEQ ID NO: 1217 - DNA, 25 bp, Artificial Sequence
  Synthetic oligonucleotide
cuuuugguuccaaguccaauauggc

SEQ ID NO: 1218 - DNA, 25 bp, Artificial Sequence
  Synthetic oligonucleotide
uuuugguuccaaguccaauauggca

SEQ ID NO: 1219 - DNA, 25 bp, Artificial Sequence
  Synthetic oligonucleotide
uuugguuccaaguccaauauggcaa

SEQ ID NO: 1220 - DNA, 25 bp, Artificial Sequence
  Synthetic oligonucleotide
uugguuccaaguccaauauggcaac

SEQ ID NO: 1221 - DNA, 25 bp, Artificial Sequence
  Synthetic oligonucleotide
ugguuccaaguccaauauggcaact

SEQ ID NO: 1222 - DNA, 25 bp, Artificial Sequence
  Synthetic oligonucleotide
gguuccaaguccaauauggcaactc

SEQ ID NO: 1223 - DNA, 25 bp, Artificial Sequence
  Synthetic oligonucleotide
guuccaaguccaauauggcaacuct

SEQ ID NO: 1224 - DNA, 25 bp, Artificial Sequence
  Synthetic oligonucleotide
uuccaaguccaauauggcaacucta

SEQ ID NO: 1225 - DNA, 25 bp, Artificial Sequence
  Synthetic oligonucleotide
uccaaguccaauauggcaacucuaa

SEQ ID NO: 1226 - DNA, 25 bp, Artificial Sequence
  Synthetic oligonucleotide
ccaaguccaauauggcaacucuaaa

SEQ ID NO: 1227 - DNA, 25 bp, Artificial Sequence
  Synthetic oligonucleotide
caaguccaauauggcaacucuaaag

SEQ ID NO: 1228 - DNA, 25 bp, Artificial Sequence
  Synthetic oligonucleotide
aaguccaauauggcaacucuaaagg

SEQ ID NO: 1229 - DNA, 25 bp, Artificial Sequence
  Synthetic oligonucleotide
aguccaauauggcaacucuaaagga

SEQ ID NO: 1230 - DNA, 25 bp, Artificial Sequence
  Synthetic oligonucleotide
guccaauauggcaacucuaaaggat

SEQ ID NO: 1231 - DNA, 25 bp, Artificial Sequence
  Synthetic oligonucleotide
uccaauauggcaacucuaaaggatc

SEQ ID NO: 1232 - DNA, 25 bp, Artificial Sequence
  Synthetic oligonucleotide
ccaauauggcaacucuaaaggauca

SEQ ID NO: 1233 - DNA, 25 bp, Artificial Sequence
  Synthetic oligonucleotide
caauauggcaacucuaaaggaucag

SEQ ID NO: 1234 - DNA, 25 bp, Artificial Sequence
  Synthetic oligonucleotide
aauauggcaacucuaaaggaucagc

SEQ ID NO: 1235 - DNA, 25 bp, Artificial Sequence
  Synthetic oligonucleotide
auauggcaacucuaaaggaucagct

SEQ ID NO: 1236 - DNA, 25 bp, Artificial Sequence
  Synthetic oligonucleotide
uauggcaacucuaaaggaucagctg

SEQ ID NO: 1237 - DNA, 25 bp, Artificial Sequence
  Synthetic oligonucleotide
auggcaacucuaaaggaucagcuga

SEQ ID NO: 1238 - DNA, 25 bp, Artificial Sequence
  Synthetic oligonucleotide
uggcaacucuaaaggaucagcugat

SEQ ID NO: 1239 - DNA, 25 bp, Artificial Sequence
  Synthetic oligonucleotide
ggcaacucuaaaggaucagcugatt

SEQ ID NO: 1240 - DNA, 25 bp, Artificial Sequence
  Synthetic oligonucleotide
gcaacucuaaaggaucagcugautt

SEQ ID NO: 1241 - DNA, 25 bp, Artificial Sequence
  Synthetic oligonucleotide
caacucuaaaggaucagcugauuta

SEQ ID NO: 1242 - DNA, 25 bp, Artificial Sequence
  Synthetic oligonucleotide
aacucuaaaggaucagcugauuuat

SEQ ID NO: 1243 - DNA, 25 bp, Artificial Sequence
  Synthetic oligonucleotide
acucuaaaggaucagcugauuuata

SEQ ID NO: 1244 - DNA, 25 bp, Artificial Sequence
  Synthetic oligonucleotide
cucuaaaggaucagcugauuuauaa

SEQ ID NO: 1245 - DNA, 25 bp, Artificial Sequence
  Synthetic oligonucleotide
ucuaaaggaucagcugauuuauaat

SEQ ID NO: 1246 - DNA, 25 bp, Artificial Sequence
  Synthetic oligonucleotide
cuaaaggaucagcugauuuauaatc

SEQ ID NO: 1247 - DNA, 25 bp, Artificial Sequence
  Synthetic oligonucleotide
uaaaggaucagcugauuuauaauct

SEQ ID NO: 1248 - DNA, 25 bp, Artificial Sequence
  Synthetic oligonucleotide
aaaggaucagcugauuuauaauctt

SEQ ID NO: 1249 - DNA, 25 bp, Artificial Sequence
  Synthetic oligonucleotide
aaggaucagcugauuuauaaucutc

SEQ ID NO: 1250 - DNA, 25 bp, Artificial Sequence
  Synthetic oligonucleotide
aggaucagcugauuuauaaucuuct

SEQ ID NO: 1251 - DNA, 25 bp, Artificial Sequence
  Synthetic oligonucleotide
ggaucagcugauuuauaaucuucta

SEQ ID NO: 1252 - DNA, 25 bp, Artificial Sequence
  Synthetic oligonucleotide
gaucagcugauuuauaaucuucuaa

SEQ ID NO: 1253 - DNA, 25 bp, Artificial Sequence
  Synthetic oligonucleotide
aucagcugauuuauaaucuucuaaa

SEQ ID NO: 1254 - DNA, 25 bp, Artificial Sequence
  Synthetic oligonucleotide
ucagcugauuuauaaucuucuaaag

SEQ ID NO: 1255 - DNA, 25 bp, Artificial Sequence
  Synthetic oligonucleotide
cagcugauuuauaaucuucuaaagg

SEQ ID NO: 1256 - DNA, 25 bp, Artificial Sequence
  Synthetic oligonucleotide
agcugauuuauaaucuucuaaagga

SEQ ID NO: 1257 - DNA, 25 bp, Artificial Sequence
  Synthetic oligonucleotide
gcugauuuauaaucuucuaaaggaa

SEQ ID NO: 1258 - DNA, 25 bp, Artificial Sequence
  Synthetic oligonucleotide
cugauuuauaaucuucuaaaggaag

SEQ ID NO: 1259 - DNA, 25 bp, Artificial Sequence
  Synthetic oligonucleotide
ugauuuauaaucuucuaaaggaaga

SEQ ID NO: 1260 - DNA, 25 bp, Artificial Sequence
  Synthetic oligonucleotide
gauuuauaaucuucuaaaggaagaa

SEQ ID NO: 1261 - DNA, 25 bp, Artificial Sequence
  Synthetic oligonucleotide
auuuauaaucuucuaaaggaagaac

SEQ ID NO: 1262 - DNA, 25 bp, Artificial Sequence
  Synthetic oligonucleotide
uuuauaaucuucuaaaggaagaaca

SEQ ID NO: 1263 - DNA, 25 bp, Artificial Sequence
  Synthetic oligonucleotide
uuauaaucuucuaaaggaagaacag

SEQ ID NO: 1264 - DNA, 25 bp, Artificial Sequence
  Synthetic oligonucleotide
uauaaucuucuaaaggaagaacaga

SEQ ID NO: 1265 - DNA, 25 bp, Artificial Sequence
  Synthetic oligonucleotide
auaaucuucuaaaggaagaacagac

SEQ ID NO: 1266 - DNA, 25 bp, Artificial Sequence
  Synthetic oligonucleotide
uaaucuucuaaaggaagaacagacc

SEQ ID NO: 1267 - DNA, 25 bp, Artificial Sequence
  Synthetic oligonucleotide
aaucuucuaaaggaagaacagaccc

SEQ ID NO: 1268 - DNA, 25 bp, Artificial Sequence
  Synthetic oligonucleotide
aucuucuaaaggaagaacagacccc

SEQ ID NO: 1269 - DNA, 25 bp, Artificial Sequence
  Synthetic oligonucleotide
ucuucuaaaggaagaacagaccccc

SEQ ID NO: 1270 - DNA, 25 bp, Artificial Sequence
  Synthetic oligonucleotide
cuucuaaaggaagaacagacccccc

SEQ ID NO: 1271 - DNA, 25 bp, Artificial Sequence
  Synthetic oligonucleotide
uucuaaaggaagaacagacccccca

SEQ ID NO: 1272 - DNA, 25 bp, Artificial Sequence
  Synthetic oligonucleotide
ucuaaaggaagaacagaccccccag

SEQ ID NO: 1273 - DNA, 25 bp, Artificial Sequence
  Synthetic oligonucleotide
cuaaaggaagaacagaccccccaga

SEQ ID NO: 1274 - DNA, 25 bp, Artificial Sequence
  Synthetic oligonucleotide
uaaaggaagaacagaccccccagaa

SEQ ID NO: 1275 - DNA, 25 bp, Artificial Sequence
  Synthetic oligonucleotide
aaaggaagaacagaccccccagaat

SEQ ID NO: 1276 - DNA, 25 bp, Artificial Sequence
  Synthetic oligonucleotide
aaggaagaacagaccccccagaata

SEQ ID NO: 1277 - DNA, 25 bp, Artificial Sequence
  Synthetic oligonucleotide
aggaagaacagaccccccagaauaa

SEQ ID NO: 1278 - DNA, 25 bp, Artificial Sequence
  Synthetic oligonucleotide
ggaagaacagaccccccagaauaag

SEQ ID NO: 1279 - DNA, 25 bp, Artificial Sequence
  Synthetic oligonucleotide
gaagaacagaccccccagaauaaga

SEQ ID NO: 1280 - DNA, 25 bp, Artificial Sequence
  Synthetic oligonucleotide
aagaacagaccccccagaauaagat

SEQ ID NO: 1281 - DNA, 25 bp, Artificial Sequence
  Synthetic oligonucleotide
agaacagaccccccagaauaagatt

SEQ ID NO: 1282 - DNA, 25 bp, Artificial Sequence
  Synthetic oligonucleotide
gaacagaccccccagaauaagauta

SEQ ID NO: 1283 - DNA, 25 bp, Artificial Sequence
  Synthetic oligonucleotide
aacagaccccccagaauaagauuac

SEQ ID NO: 1284 - DNA, 25 bp, Artificial Sequence
  Synthetic oligonucleotide
acagaccccccagaauaagauuaca

SEQ ID NO: 1285 - DNA, 25 bp, Artificial Sequence
  Synthetic oligonucleotide
cagaccccccagaauaagauuacag

SEQ ID NO: 1286 - DNA, 25 bp, Artificial Sequence
  Synthetic oligonucleotide
agaccccccagaauaagauuacagt

SEQ ID NO: 1287 - DNA, 25 bp, Artificial Sequence
  Synthetic oligonucleotide
gaccccccagaauaagauuacagtt

SEQ ID NO: 1288 - DNA, 25 bp, Artificial Sequence
  Synthetic oligonucleotide
accccccagaauaagauuacagutg

SEQ ID NO: 1289 - DNA, 25 bp, Artificial Sequence
  Synthetic oligonucleotide
ccccccagaauaagauuacaguugt

SEQ ID NO: 1290 - DNA, 25 bp, Artificial Sequence
  Synthetic oligonucleotide
cccccagaauaagauuacaguugtt

SEQ ID NO: 1291 - DNA, 25 bp, Artificial Sequence
  Synthetic oligonucleotide
ccccagaauaagauuacaguugutg

SEQ ID NO: 1292 - DNA, 25 bp, Artificial Sequence
  Synthetic oligonucleotide
cccagaauaagauuacaguuguugg

SEQ ID NO: 1293 - DNA, 25 bp, Artificial Sequence
  Synthetic oligonucleotide
ccagaauaagauuacaguuguuggg

SEQ ID NO: 1294 - DNA, 25 bp, Artificial Sequence
  Synthetic oligonucleotide
cagaauaagauuacaguuguugggg

SEQ ID NO: 1295 - DNA, 25 bp, Artificial Sequence
  Synthetic oligonucleotide
aauaagauuacaguuguuggggutg

SEQ ID NO: 1296 - DNA, 25 bp, Artificial Sequence
  Synthetic oligonucleotide
auaagauuacaguuguugggguugg

SEQ ID NO: 1297 - DNA, 25 bp, Artificial Sequence
  Synthetic oligonucleotide
uaagauuacaguuguugggguuggt

SEQ ID NO: 1298 - DNA, 25 bp, Artificial Sequence
  Synthetic oligonucleotide
aguuguugggguuggugcuguuggc

SEQ ID NO: 1299 - DNA, 25 bp, Artificial Sequence
  Synthetic oligonucleotide
uguugggguuggugcuguuggcatg

SEQ ID NO: 1300 - DNA, 25 bp, Artificial Sequence
  Synthetic oligonucleotide
guugggguuggugcuguuggcaugg

SEQ ID NO: 1301 - DNA, 25 bp, Artificial Sequence
  Synthetic oligonucleotide
uugggguuggugcuguuggcauggc

SEQ ID NO: 1302 - DNA, 25 bp, Artificial Sequence
  Synthetic oligonucleotide
ugggguuggugcuguuggcauggcc

SEQ ID NO: 1303 - DNA, 25 bp, Artificial Sequence
  Synthetic oligonucleotide
gggguuggugcuguuggcauggcct

SEQ ID NO: 1304 - DNA, 25 bp, Artificial Sequence
  Synthetic oligonucleotide
ggguuggugcuguuggcauggcctg

SEQ ID NO: 1305 - DNA, 25 bp, Artificial Sequence
  Synthetic oligonucleotide
gguuggugcuguuggcauggccugt

SEQ ID NO: 1306 - DNA, 25 bp, Artificial Sequence
  Synthetic oligonucleotide
guuggugcuguuggcauggccugtg

SEQ ID NO: 1307 - DNA, 25 bp, Artificial Sequence
  Synthetic oligonucleotide
uuggugcuguuggcauggccugugc

SEQ ID NO: 1308 - DNA, 25 bp, Artificial Sequence
  Synthetic oligonucleotide
uggugcuguuggcauggccugugcc

SEQ ID NO: 1309 - DNA, 25 bp, Artificial Sequence
  Synthetic oligonucleotide
ggugcuguuggcauggccugugcca

SEQ ID NO: 1310 - DNA, 25 bp, Artificial Sequence
  Synthetic oligonucleotide
gugcuguuggcauggccugugccat

SEQ ID NO: 1311 - DNA, 25 bp, Artificial Sequence
  Synthetic oligonucleotide
ugcuguuggcauggccugugccatc

SEQ ID NO: 1312 - DNA, 25 bp, Artificial Sequence
  Synthetic oligonucleotide
gcuguuggcauggccugugccauca

SEQ ID NO: 1313 - DNA, 25 bp, Artificial Sequence
  Synthetic oligonucleotide
cuguuggcauggccugugccaucag

SEQ ID NO: 1314 - DNA, 25 bp, Artificial Sequence
  Synthetic oligonucleotide
uguuggcauggccugugccaucagt

SEQ ID NO: 1315 - DNA, 25 bp, Artificial Sequence
  Synthetic oligonucleotide
guuggcauggccugugccaucagta

SEQ ID NO: 1316 - DNA, 25 bp, Artificial Sequence
  Synthetic oligonucleotide
uuggcauggccugugccaucaguat

SEQ ID NO: 1317 - DNA, 25 bp, Artificial Sequence
  Synthetic oligonucleotide
uggcauggccugugccaucaguatc

SEQ ID NO: 1318 - DNA, 25 bp, Artificial Sequence
  Synthetic oligonucleotide
ggcauggccugugccaucaguauct

SEQ ID NO: 1319 - DNA, 25 bp, Artificial Sequence
  Synthetic oligonucleotide
gcauggccugugccaucaguauctt

SEQ ID NO: 1320 - DNA, 25 bp, Artificial Sequence
  Synthetic oligonucleotide
cauggccugugccaucaguaucuta

SEQ ID NO: 1321 - DNA, 25 bp, Artificial Sequence
  Synthetic oligonucleotide
auggccugugccaucaguaucuuaa

SEQ ID NO: 1322 - DNA, 25 bp, Artificial Sequence
  Synthetic oligonucleotide
uggccugugccaucaguaucuuaat

SEQ ID NO: 1323 - DNA, 25 bp, Artificial Sequence
  Synthetic oligonucleotide
ggccugugccaucaguaucuuaatg

SEQ ID NO: 1324 - DNA, 25 bp, Artificial Sequence
  Synthetic oligonucleotide
gccugugccaucaguaucuuaauga

SEQ ID NO: 1325 - DNA, 25 bp, Artificial Sequence
  Synthetic oligonucleotide
aucaguaucuuaaugaaggacuugg

SEQ ID NO: 1326 - DNA, 25 bp, Artificial Sequence
  Synthetic oligonucleotide
ucaguaucuuaaugaaggacuuggc

SEQ ID NO: 1327 - DNA, 25 bp, Artificial Sequence
  Synthetic oligonucleotide
caguaucuuaaugaaggacuuggca

SEQ ID NO: 1328 - DNA, 25 bp, Artificial Sequence
  Synthetic oligonucleotide
aguaucuuaaugaaggacuuggcag

SEQ ID NO: 1329 - DNA, 25 bp, Artificial Sequence
  Synthetic oligonucleotide
guaucuuaaugaaggacuuggcaga

SEQ ID NO: 1330 - DNA, 25 bp, Artificial Sequence
  Synthetic oligonucleotide
uaucuuaaugaaggacuuggcagat

SEQ ID NO: 1331 - DNA, 25 bp, Artificial Sequence
  Synthetic oligonucleotide
aucuuaaugaaggacuuggcagatg

SEQ ID NO: 1332 - DNA, 25 bp, Artificial Sequence
  Synthetic oligonucleotide
ucuuaaugaaggacuuggcagauga

SEQ ID NO: 1333 - DNA, 25 bp, Artificial Sequence
  Synthetic oligonucleotide
cuuaaugaaggacuuggcagaugaa

SEQ ID NO: 1334 - DNA, 25 bp, Artificial Sequence
  Synthetic oligonucleotide
uuaaugaaggacuuggcagaugaac

SEQ ID NO: 1335 - DNA, 25 bp, Artificial Sequence
  Synthetic oligonucleotide
uaaugaaggacuuggcagaugaact

SEQ ID NO: 1336 - DNA, 25 bp, Artificial Sequence
  Synthetic oligonucleotide
aaugaaggacuuggcagaugaactt

SEQ ID NO: 1337 - DNA, 25 bp, Artificial Sequence
  Synthetic oligonucleotide
augaaggacuuggcagaugaacutg

SEQ ID NO: 1338 - DNA, 25 bp, Artificial Sequence
  Synthetic oligonucleotide
ugaaggacuuggcagaugaacuugc

SEQ ID NO: 1339 - DNA, 25 bp, Artificial Sequence
  Synthetic oligonucleotide
gaaggacuuggcagaugaacuugct

SEQ ID NO: 1340 - DNA, 25 bp, Artificial Sequence
  Synthetic oligonucleotide
aaggacuuggcagaugaacuugctc

SEQ ID NO: 1341 - DNA, 25 bp, Artificial Sequence
  Synthetic oligonucleotide
aggacuuggcagaugaacuugcuct

SEQ ID NO: 1342 - DNA, 25 bp, Artificial Sequence
  Synthetic oligonucleotide
ggacuuggcagaugaacuugcuctt

SEQ ID NO: 1343 - DNA, 25 bp, Artificial Sequence
  Synthetic oligonucleotide
gacuuggcagaugaacuugcucutg

SEQ ID NO: 1344 - DNA, 25 bp, Artificial Sequence
  Synthetic oligonucleotide
acuuggcagaugaacuugcucuugt

SEQ ID NO: 1345 - DNA, 25 bp, Artificial Sequence
  Synthetic oligonucleotide
cuuggcagaugaacuugcucuugtt

SEQ ID NO: 1346 - DNA, 25 bp, Artificial Sequence
  Synthetic oligonucleotide
uuggcagaugaacuugcucuugutg

SEQ ID NO: 1347 - DNA, 25 bp, Artificial Sequence
  Synthetic oligonucleotide
uggcagaugaacuugcucuuguuga

SEQ ID NO: 1348 - DNA, 25 bp, Artificial Sequence
  Synthetic oligonucleotide
ggcagaugaacuugcucuuguugat

SEQ ID NO: 1349 - DNA, 25 bp, Artificial Sequence
  Synthetic oligonucleotide
gcagaugaacuugcucuuguugatg

SEQ ID NO: 1350 - DNA, 25 bp, Artificial Sequence
  Synthetic oligonucleotide
cagaugaacuugcucuuguugaugt

SEQ ID NO: 1351 - DNA, 25 bp, Artificial Sequence
  Synthetic oligonucleotide
agaugaacuugcucuuguugaugtc

SEQ ID NO: 1352 - DNA, 25 bp, Artificial Sequence
  Synthetic oligonucleotide
gaugaacuugcucuuguugauguca

SEQ ID NO: 1353 - DNA, 25 bp, Artificial Sequence
  Synthetic oligonucleotide
augaacuugcucuuguugaugucat

SEQ ID NO: 1354 - DNA, 25 bp, Artificial Sequence
  Synthetic oligonucleotide
ugaacuugcucuuguugaugucatc

SEQ ID NO: 1355 - DNA, 25 bp, Artificial Sequence
  Synthetic oligonucleotide
gaacuugcucuuguugaugucaucg

SEQ ID NO: 1356 - DNA, 25 bp, Artificial Sequence
  Synthetic oligonucleotide
aacuugcucuuguugaugucaucga

SEQ ID NO: 1357 - DNA, 25 bp, Artificial Sequence
  Synthetic oligonucleotide
acuugcucuuguugaugucaucgaa

SEQ ID NO: 1358 - DNA, 25 bp, Artificial Sequence
  Synthetic oligonucleotide
cuugcucuuguugaugucaucgaag

SEQ ID NO: 1359 - DNA, 25 bp, Artificial Sequence
  Synthetic oligonucleotide
uugcucuuguugaugucaucgaaga

SEQ ID NO: 1360 - DNA, 25 bp, Artificial Sequence
  Synthetic oligonucleotide
ugcucuuguugaugucaucgaagac

SEQ ID NO: 1361 - DNA, 25 bp, Artificial Sequence
  Synthetic oligonucleotide
gcucuuguugaugucaucgaagaca

SEQ ID NO: 1362 - DNA, 25 bp, Artificial Sequence
  Synthetic oligonucleotide
cucuuguugaugucaucgaagacaa

SEQ ID NO: 1363 - DNA, 25 bp, Artificial Sequence
  Synthetic oligonucleotide
ucuuguugaugucaucgaagacaaa

SEQ ID NO: 1364 - DNA, 25 bp, Artificial Sequence
  Synthetic oligonucleotide
cuuguugaugucaucgaagacaaat

SEQ ID NO: 1365 - DNA, 25 bp, Artificial Sequence
  Synthetic oligonucleotide
uuguugaugucaucgaagacaaatt

SEQ ID NO: 1366 - DNA, 25 bp, Artificial Sequence
  Synthetic oligonucleotide
uguugaugucaucgaagacaaautg

SEQ ID NO: 1367 - DNA, 25 bp, Artificial Sequence
  Synthetic oligonucleotide
guugaugucaucgaagacaaauuga

SEQ ID NO: 1368 - DNA, 25 bp, Artificial Sequence
  Synthetic oligonucleotide
uugaugucaucgaagacaaauugaa

SEQ ID NO: 1369 - DNA, 25 bp, Artificial Sequence
  Synthetic oligonucleotide
ugaugucaucgaagacaaauugaag

SEQ ID NO: 1370 - DNA, 25 bp, Artificial Sequence
  Synthetic oligonucleotide
gaugucaucgaagacaaauugaagg

SEQ ID NO: 1371 - DNA, 25 bp, Artificial Sequence
  Synthetic oligonucleotide
augucaucgaagacaaauugaaggg

SEQ ID NO: 1372 - DNA, 25 bp, Artificial Sequence
  Synthetic oligonucleotide
ugucaucgaagacaaauugaaggga

SEQ ID NO: 1373 - DNA, 25 bp, Artificial Sequence
  Synthetic oligonucleotide
gucaucgaagacaaauugaagggag

SEQ ID NO: 1374 - DNA, 25 bp, Artificial Sequence
  Synthetic oligonucleotide
ucaucgaagacaaauugaagggaga

SEQ ID NO: 1375 - DNA, 25 bp, Artificial Sequence
  Synthetic oligonucleotide
caucgaagacaaauugaagggagag

SEQ ID NO: 1376 - DNA, 25 bp, Artificial Sequence
  Synthetic oligonucleotide
aucgaagacaaauugaagggagaga

SEQ ID NO: 1377 - DNA, 25 bp, Artificial Sequence
  Synthetic oligonucleotide
ucgaagacaaauugaagggagagat

SEQ ID NO: 1378 - DNA, 25 bp, Artificial Sequence
  Synthetic oligonucleotide
cgaagacaaauugaagggagagatg

SEQ ID NO: 1379 - DNA, 25 bp, Artificial Sequence
  Synthetic oligonucleotide
gaagacaaauugaagggagagauga

SEQ ID NO: 1380 - DNA, 25 bp, Artificial Sequence
  Synthetic oligonucleotide
aagacaaauugaagggagagaugat

SEQ ID NO: 1381 - DNA, 25 bp, Artificial Sequence
  Synthetic oligonucleotide
agacaaauugaagggagagaugatg

SEQ ID NO: 1382 - DNA, 25 bp, Artificial Sequence
  Synthetic oligonucleotide
gacaaauugaagggagagaugaugg

SEQ ID NO: 1383 - DNA, 25 bp, Artificial Sequence
  Synthetic oligonucleotide
acaaauugaagggagagaugaugga

SEQ ID NO: 1384 - DNA, 25 bp, Artificial Sequence
  Synthetic oligonucleotide
caaauugaagggagagaugauggat

SEQ ID NO: 1385 - DNA, 25 bp, Artificial Sequence
  Synthetic oligonucleotide
aaauugaagggagagaugauggatc

SEQ ID NO: 1386 - DNA, 25 bp, Artificial Sequence
  Synthetic oligonucleotide
aauugaagggagagaugauggauct

SEQ ID NO: 1387 - DNA, 25 bp, Artificial Sequence
  Synthetic oligonucleotide
auugaagggagagaugauggauctc

SEQ ID NO: 1388 - DNA, 25 bp, Artificial Sequence
  Synthetic oligonucleotide
uugaagggagagaugauggaucucc

SEQ ID NO: 1389 - DNA, 25 bp, Artificial Sequence
  Synthetic oligonucleotide
ugaagggagagaugauggaucucca

SEQ ID NO: 1390 - DNA, 25 bp, Artificial Sequence
  Synthetic oligonucleotide
gaagggagagaugauggaucuccaa

SEQ ID NO: 1391 - DNA, 25 bp, Artificial Sequence
  Synthetic oligonucleotide
aagggagagaugauggaucuccaac

SEQ ID NO: 1392 - DNA, 25 bp, Artificial Sequence
  Synthetic oligonucleotide
agggagagaugauggaucuccaaca

SEQ ID NO: 1393 - DNA, 25 bp, Artificial Sequence
  Synthetic oligonucleotide
gggagagaugauggaucuccaacat

SEQ ID NO: 1394 - DNA, 25 bp, Artificial Sequence
  Synthetic oligonucleotide
ggagagaugauggaucuccaacatg

SEQ ID NO: 1395 - DNA, 25 bp, Artificial Sequence
  Synthetic oligonucleotide
gagagaugauggaucuccaacaugg

SEQ ID NO: 1396 - DNA, 25 bp, Artificial Sequence
  Synthetic oligonucleotide
agagaugauggaucuccaacauggc

SEQ ID NO: 1397 - DNA, 25 bp, Artificial Sequence
  Synthetic oligonucleotide
gagaugauggaucuccaacauggca

SEQ ID NO: 1398 - DNA, 25 bp, Artificial Sequence
  Synthetic oligonucleotide
agaugauggaucuccaacauggcag

SEQ ID NO: 1399 - DNA, 25 bp, Artificial Sequence
  Synthetic oligonucleotide
gaugauggaucuccaacauggcagc

SEQ ID NO: 1400 - DNA, 25 bp, Artificial Sequence
  Synthetic oligonucleotide
augauggaucuccaacauggcagcc

SEQ ID NO: 1401 - DNA, 25 bp, Artificial Sequence
  Synthetic oligonucleotide
ugauggaucuccaacauggcagcct

SEQ ID NO: 1402 - DNA, 25 bp, Artificial Sequence
  Synthetic oligonucleotide
gauggaucuccaacauggcagcctt

SEQ ID NO: 1403 - DNA, 25 bp, Artificial Sequence
  Synthetic oligonucleotide
auggaucuccaacauggcagccutt

SEQ ID NO: 1404 - DNA, 25 bp, Artificial Sequence
  Synthetic oligonucleotide
uggaucuccaacauggcagccuutt

SEQ ID NO: 1405 - DNA, 25 bp, Artificial Sequence
  Synthetic oligonucleotide
ggaucuccaacauggcagccuuutc

SEQ ID NO: 1406 - DNA, 25 bp, Artificial Sequence
  Synthetic oligonucleotide
gaucuccaacauggcagccuuuucc

SEQ ID NO: 1407 - DNA, 25 bp, Artificial Sequence
  Synthetic oligonucleotide
aucuccaacauggcagccuuuucct

SEQ ID NO: 1408 - DNA, 25 bp, Artificial Sequence
  Synthetic oligonucleotide
ucuccaacauggcagccuuuucctt

SEQ ID NO: 1409 - DNA, 25 bp, Artificial Sequence
  Synthetic oligonucleotide
cuccaacauggcagccuuuuccuta

SEQ ID NO: 1410 - DNA, 25 bp, Artificial Sequence
  Synthetic oligonucleotide
uccaacauggcagccuuuuccuuag

SEQ ID NO: 1411 - DNA, 25 bp, Artificial Sequence
  Synthetic oligonucleotide
ccaacauggcagccuuuuccuuaga

SEQ ID NO: 1412 - DNA, 25 bp, Artificial Sequence
  Synthetic oligonucleotide
caacauggcagccuuuuccuuagaa

SEQ ID NO: 1413 - DNA, 25 bp, Artificial Sequence
  Synthetic oligonucleotide
aacauggcagccuuuuccuuagaac

SEQ ID NO: 1414 - DNA, 25 bp, Artificial Sequence
  Synthetic oligonucleotide
acauggcagccuuuuccuuagaaca

SEQ ID NO: 1415 - DNA, 25 bp, Artificial Sequence
  Synthetic oligonucleotide
cauggcagccuuuuccuuagaacac

SEQ ID NO: 1416 - DNA, 25 bp, Artificial Sequence
  Synthetic oligonucleotide
auggcagccuuuuccuuagaacacc

SEQ ID NO: 1417 - DNA, 25 bp, Artificial Sequence
  Synthetic oligonucleotide
uggcagccuuuuccuuagaacacca

SEQ ID NO: 1418 - DNA, 25 bp, Artificial Sequence
  Synthetic oligonucleotide
ggcagccuuuuccuuagaacaccaa

SEQ ID NO: 1419 - DNA, 25 bp, Artificial Sequence
  Synthetic oligonucleotide
gcagccuuuuccuuagaacaccaaa

SEQ ID NO: 1420 - DNA, 25 bp, Artificial Sequence
  Synthetic oligonucleotide
cagccuuuuccuuagaacaccaaag

SEQ ID NO: 1421 - DNA, 25 bp, Artificial Sequence
  Synthetic oligonucleotide
agccuuuuccuuagaacaccaaaga

SEQ ID NO: 1422 - DNA, 25 bp, Artificial Sequence
  Synthetic oligonucleotide
gccuuuuccuuagaacaccaaagat

SEQ ID NO: 1423 - DNA, 25 bp, Artificial Sequence
  Synthetic oligonucleotide
ccuuuuccuuagaacaccaaagatt

SEQ ID NO: 1424 - DNA, 25 bp, Artificial Sequence
  Synthetic oligonucleotide
cuuuuccuuagaacaccaaagautg

SEQ ID NO: 1425 - DNA, 25 bp, Artificial Sequence
  Synthetic oligonucleotide
uuuuccuuagaacaccaaagauugt

SEQ ID NO: 1426 - DNA, 25 bp, Artificial Sequence
  Synthetic oligonucleotide
uuuccuuagaacaccaaagauugtc

SEQ ID NO: 1427 - DNA, 25 bp, Artificial Sequence
  Synthetic oligonucleotide
uuccuuagaacaccaaagauuguct

SEQ ID NO: 1428 - DNA, 25 bp, Artificial Sequence
  Synthetic oligonucleotide
uccuuagaacaccaaagauuguctc

SEQ ID NO: 1429 - DNA, 25 bp, Artificial Sequence
  Synthetic oligonucleotide
ccuuagaacaccaaagauugucuct

SEQ ID NO: 1430 - DNA, 25 bp, Artificial Sequence
  Synthetic oligonucleotide
cuuagaacaccaaagauugucuctg

SEQ ID NO: 1431 - DNA, 25 bp, Artificial Sequence
  Synthetic oligonucleotide
uuagaacaccaaagauugucucugg

SEQ ID NO: 1432 - DNA, 25 bp, Artificial Sequence
  Synthetic oligonucleotide
uagaacaccaaagauugucucuggc

SEQ ID NO: 1433 - DNA, 25 bp, Artificial Sequence
  Synthetic oligonucleotide
agaacaccaaagauugucucuggca

SEQ ID NO: 1434 - DNA, 25 bp, Artificial Sequence
  Synthetic oligonucleotide
gaacaccaaagauugucucuggcaa

SEQ ID NO: 1435 - DNA, 25 bp, Artificial Sequence
  Synthetic oligonucleotide
aacaccaaagauugucucuggcaaa

SEQ ID NO: 1436 - DNA, 25 bp, Artificial Sequence
  Synthetic oligonucleotide
acaccaaagauugucucuggcaaag

SEQ ID NO: 1437 - DNA, 25 bp, Artificial Sequence
  Synthetic oligonucleotide
caccaaagauugucucuggcaaaga

SEQ ID NO: 1438 - DNA, 25 bp, Artificial Sequence
  Synthetic oligonucleotide
accaaagauugucucuggcaaagac

SEQ ID NO: 1439 - DNA, 25 bp, Artificial Sequence
  Synthetic oligonucleotide
ccaaagauugucucuggcaaagact

SEQ ID NO: 1440 - DNA, 25 bp, Artificial Sequence
  Synthetic oligonucleotide
caaagauugucucuggcaaagacta

SEQ ID NO: 1441 - DNA, 25 bp, Artificial Sequence
  Synthetic oligonucleotide
aaagauugucucuggcaaagacuat

SEQ ID NO: 1442 - DNA, 25 bp, Artificial Sequence
  Synthetic oligonucleotide
aagauugucucuggcaaagacuata

SEQ ID NO: 1443 - DNA, 25 bp, Artificial Sequence
  Synthetic oligonucleotide
agauugucucuggcaaagacuauaa

SEQ ID NO: 1444 - DNA, 25 bp, Artificial Sequence
  Synthetic oligonucleotide
gauugucucuggcaaagacuauaat

SEQ ID NO: 1445 - DNA, 25 bp, Artificial Sequence
  Synthetic oligonucleotide
auugucucuggcaaagacuauaatg

SEQ ID NO: 1446 - DNA, 25 bp, Artificial Sequence
  Synthetic oligonucleotide
uugucucuggcaaagacuauaaugt

SEQ ID NO: 1447 - DNA, 25 bp, Artificial Sequence
  Synthetic oligonucleotide
ugucucuggcaaagacuauaaugta

SEQ ID NO: 1448 - DNA, 25 bp, Artificial Sequence
  Synthetic oligonucleotide
gucucuggcaaagacuauaauguaa

SEQ ID NO: 1449 - DNA, 25 bp, Artificial Sequence
  Synthetic oligonucleotide
ucucuggcaaagacuauaauguaac

SEQ ID NO: 1450 - DNA, 25 bp, Artificial Sequence
  Synthetic oligonucleotide
cucuggcaaagacuauaauguaact

SEQ ID NO: 1451 - DNA, 25 bp, Artificial Sequence
  Synthetic oligonucleotide
ucuggcaaagacuauaauguaactg

SEQ ID NO: 1452 - DNA, 25 bp, Artificial Sequence
  Synthetic oligonucleotide
cuggcaaagacuauaauguaacugc

SEQ ID NO: 1453 - DNA, 25 bp, Artificial Sequence
  Synthetic oligonucleotide
uggcaaagacuauaauguaacugca

SEQ ID NO: 1454 - DNA, 25 bp, Artificial Sequence
  Synthetic oligonucleotide
ggcaaagacuauaauguaacugcaa

SEQ ID NO: 1455 - DNA, 25 bp, Artificial Sequence
  Synthetic oligonucleotide
gcaaagacuauaauguaacugcaaa

SEQ ID NO: 1456 - DNA, 25 bp, Artificial Sequence
  Synthetic oligonucleotide
caaagacuauaauguaacugcaaac

SEQ ID NO: 1457 - DNA, 25 bp, Artificial Sequence
  Synthetic oligonucleotide
aaagacuauaauguaacugcaaact

SEQ ID NO: 1458 - DNA, 25 bp, Artificial Sequence
  Synthetic oligonucleotide
aagacuauaauguaacugcaaactc

SEQ ID NO: 1459 - DNA, 25 bp, Artificial Sequence
  Synthetic oligonucleotide
agacuauaauguaacugcaaacucc

SEQ ID NO: 1460 - DNA, 25 bp, Artificial Sequence
  Synthetic oligonucleotide
gacuauaauguaacugcaaacucca

SEQ ID NO: 1461 - DNA, 25 bp, Artificial Sequence
  Synthetic oligonucleotide
acuauaauguaacugcaaacuccaa

SEQ ID NO: 1462 - DNA, 25 bp, Artificial Sequence
  Synthetic oligonucleotide
cuauaauguaacugcaaacuccaag

SEQ ID NO: 1463 - DNA, 25 bp, Artificial Sequence
  Synthetic oligonucleotide
uauaauguaacugcaaacuccaagc

SEQ ID NO: 1464 - DNA, 25 bp, Artificial Sequence
  Synthetic oligonucleotide
auaauguaacugcaaacuccaagct

SEQ ID NO: 1465 - DNA, 25 bp, Artificial Sequence
  Synthetic oligonucleotide
uaauguaacugcaaacuccaagctg

SEQ ID NO: 1466 - DNA, 25 bp, Artificial Sequence
  Synthetic oligonucleotide
aauguaacugcaaacuccaagcugg

SEQ ID NO: 1467 - DNA, 25 bp, Artificial Sequence
  Synthetic oligonucleotide
auguaacugcaaacuccaagcuggt

SEQ ID NO: 1468 - DNA, 25 bp, Artificial Sequence
  Synthetic oligonucleotide
uguaacugcaaacuccaagcuggtc

SEQ ID NO: 1469 - DNA, 25 bp, Artificial Sequence
  Synthetic oligonucleotide
guaacugcaaacuccaagcugguca

SEQ ID NO: 1470 - DNA, 25 bp, Artificial Sequence
  Synthetic oligonucleotide
uaacugcaaacuccaagcuggucat

SEQ ID NO: 1471 - DNA, 25 bp, Artificial Sequence
  Synthetic oligonucleotide
aacugcaaacuccaagcuggucatt

SEQ ID NO: 1472 - DNA, 25 bp, Artificial Sequence
  Synthetic oligonucleotide
acugcaaacuccaagcuggucauta

SEQ ID NO: 1473 - DNA, 25 bp, Artificial Sequence
  Synthetic oligonucleotide
cugcaaacuccaagcuggucauuat

SEQ ID NO: 1474 - DNA, 25 bp, Artificial Sequence
  Synthetic oligonucleotide
ugcaaacuccaagcuggucauuatc

SEQ ID NO: 1475 - DNA, 25 bp, Artificial Sequence
  Synthetic oligonucleotide
gcaaacuccaagcuggucauuauca

SEQ ID NO: 1476 - DNA, 25 bp, Artificial Sequence
  Synthetic oligonucleotide
caaacuccaagcuggucauuaucac

SEQ ID NO: 1477 - DNA, 25 bp, Artificial Sequence
  Synthetic oligonucleotide
aaacuccaagcuggucauuaucacg

SEQ ID NO: 1478 - DNA, 25 bp, Artificial Sequence
  Synthetic oligonucleotide
aacuccaagcuggucauuaucacgg

SEQ ID NO: 1479 - DNA, 25 bp, Artificial Sequence
  Synthetic oligonucleotide
acuccaagcuggucauuaucacggc

SEQ ID NO: 1480 - DNA, 25 bp, Artificial Sequence
  Synthetic oligonucleotide
cuccaagcuggucauuaucacggct

SEQ ID NO: 1481 - DNA, 25 bp, Artificial Sequence
  Synthetic oligonucleotide
uccaagcuggucauuaucacggctg

SEQ ID NO: 1482 - DNA, 25 bp, Artificial Sequence
  Synthetic oligonucleotide
ccaagcuggucauuaucacggcugg

SEQ ID NO: 1483 - DNA, 25 bp, Artificial Sequence
  Synthetic oligonucleotide
caagcuggucauuaucacggcuggg

SEQ ID NO: 1484 - DNA, 25 bp, Artificial Sequence
  Synthetic oligonucleotide
aagcuggucauuaucacggcugggg

SEQ ID NO: 1485 - DNA, 25 bp, Artificial Sequence
  Synthetic oligonucleotide
agcuggucauuaucacggcuggggc

SEQ ID NO: 1486 - DNA, 25 bp, Artificial Sequence
  Synthetic oligonucleotide
gcuggucauuaucacggcuggggca

SEQ ID NO: 1487 - DNA, 25 bp, Artificial Sequence
  Synthetic oligonucleotide
cuggucauuaucacggcuggggcac

SEQ ID NO: 1488 - DNA, 25 bp, Artificial Sequence
  Synthetic oligonucleotide
uggucauuaucacggcuggggcacg

SEQ ID NO: 1489 - DNA, 25 bp, Artificial Sequence
  Synthetic oligonucleotide
ggucauuaucacggcuggggcacgt

SEQ ID NO: 1490 - DNA, 25 bp, Artificial Sequence
  Synthetic oligonucleotide
gucauuaucacggcuggggcacgtc

SEQ ID NO: 1491 - DNA, 25 bp, Artificial Sequence
  Synthetic oligonucleotide
ucauuaucacggcuggggcacguca

SEQ ID NO: 1492 - DNA, 25 bp, Artificial Sequence
  Synthetic oligonucleotide
cauuaucacggcuggggcacgucag

SEQ ID NO: 1493 - DNA, 25 bp, Artificial Sequence
  Synthetic oligonucleotide
auuaucacggcuggggcacgucagc

SEQ ID NO: 1494 - DNA, 25 bp, Artificial Sequence
  Synthetic oligonucleotide
uuaucacggcuggggcacgucagca

SEQ ID NO: 1495 - DNA, 25 bp, Artificial Sequence
  Synthetic oligonucleotide
uaucacggcuggggcacgucagcaa

SEQ ID NO: 1496 - DNA, 25 bp, Artificial Sequence
  Synthetic oligonucleotide
aucacggcuggggcacgucagcaag

SEQ ID NO: 1497 - DNA, 25 bp, Artificial Sequence
  Synthetic oligonucleotide
ucacggcuggggcacgucagcaaga

SEQ ID NO: 1498 - DNA, 25 bp, Artificial Sequence
  Synthetic oligonucleotide
cacggcuggggcacgucagcaagag

SEQ ID NO: 1499 - DNA, 25 bp, Artificial Sequence
  Synthetic oligonucleotide
acggcuggggcacgucagcaagagg

SEQ ID NO: 1500 - DNA, 25 bp, Artificial Sequence
  Synthetic oligonucleotide
cggcuggggcacgucagcaagaggg

SEQ ID NO: 1501 - DNA, 25 bp, Artificial Sequence
  Synthetic oligonucleotide
ggcuggggcacgucagcaagaggga

SEQ ID NO: 1502 - DNA, 25 bp, Artificial Sequence
  Synthetic oligonucleotide
gcuggggcacgucagcaagagggag

SEQ ID NO: 1503 - DNA, 25 bp, Artificial Sequence
  Synthetic oligonucleotide
cuggggcacgucagcaagagggaga

SEQ ID NO: 1504 - DNA, 25 bp, Artificial Sequence
  Synthetic oligonucleotide
uggggcacgucagcaagagggagaa

SEQ ID NO: 1505 - DNA, 25 bp, Artificial Sequence
  Synthetic oligonucleotide
ggggcacgucagcaagagggagaaa

SEQ ID NO: 1506 - DNA, 25 bp, Artificial Sequence
  Synthetic oligonucleotide
gggcacgucagcaagagggagaaag

SEQ ID NO: 1507 - DNA, 25 bp, Artificial Sequence
  Synthetic oligonucleotide
ggcacgucagcaagagggagaaagc

SEQ ID NO: 1508 - DNA, 25 bp, Artificial Sequence
  Synthetic oligonucleotide
gcacgucagcaagagggagaaagcc

SEQ ID NO: 1509 - DNA, 25 bp, Artificial Sequence
  Synthetic oligonucleotide
cacgucagcaagagggagaaagccg

SEQ ID NO: 1510 - DNA, 25 bp, Artificial Sequence
  Synthetic oligonucleotide
acgucagcaagagggagaaagccgt

SEQ ID NO: 1511 - DNA, 25 bp, Artificial Sequence
  Synthetic oligonucleotide
cgucagcaagagggagaaagccgtc

SEQ ID NO: 1512 - DNA, 25 bp, Artificial Sequence
  Synthetic oligonucleotide
gucagcaagagggagaaagccguct

SEQ ID NO: 1513 - DNA, 25 bp, Artificial Sequence
  Synthetic oligonucleotide
ucagcaagagggagaaagccguctt

SEQ ID NO: 1514 - DNA, 25 bp, Artificial Sequence
  Synthetic oligonucleotide
cagcaagagggagaaagccgucuta

SEQ ID NO: 1515 - DNA, 25 bp, Artificial Sequence
  Synthetic oligonucleotide
agcaagagggagaaagccgucuuaa

SEQ ID NO: 1516 - DNA, 25 bp, Artificial Sequence
  Synthetic oligonucleotide
gcaagagggagaaagccgucuuaat

SEQ ID NO: 1517 - DNA, 25 bp, Artificial Sequence
  Synthetic oligonucleotide
caagagggagaaagccgucuuaatt

SEQ ID NO: 1518 - DNA, 25 bp, Artificial Sequence
  Synthetic oligonucleotide
aagagggagaaagccgucuuaautt

SEQ ID NO: 1519 - DNA, 25 bp, Artificial Sequence
  Synthetic oligonucleotide
agagggagaaagccgucuuaauutg

SEQ ID NO: 1520 - DNA, 25 bp, Artificial Sequence
  Synthetic oligonucleotide
gagggagaaagccgucuuaauuugg

SEQ ID NO: 1521 - DNA, 25 bp, Artificial Sequence
  Synthetic oligonucleotide
agggagaaagccgucuuaauuuggt

SEQ ID NO: 1522 - DNA, 25 bp, Artificial Sequence
  Synthetic oligonucleotide
gggagaaagccgucuuaauuuggtc

SEQ ID NO: 1523 - DNA, 25 bp, Artificial Sequence
  Synthetic oligonucleotide
ggagaaagccgucuuaauuuggucc

SEQ ID NO: 1524 - DNA, 25 bp, Artificial Sequence
  Synthetic oligonucleotide
gagaaagccgucuuaauuuggucca

SEQ ID NO: 1525 - DNA, 25 bp, Artificial Sequence
  Synthetic oligonucleotide
agaaagccgucuuaauuugguccag

SEQ ID NO: 1526 - DNA, 25 bp, Artificial Sequence
  Synthetic oligonucleotide
gaaagccgucuuaauuugguccagc

SEQ ID NO: 1527 - DNA, 25 bp, Artificial Sequence
  Synthetic oligonucleotide
aaagccgucuuaauuugguccagcg

SEQ ID NO: 1528 - DNA, 25 bp, Artificial Sequence
  Synthetic oligonucleotide
aagccgucuuaauuugguccagcgt

SEQ ID NO: 1529 - DNA, 25 bp, Artificial Sequence
  Synthetic oligonucleotide
agccgucuuaauuugguccagcgta

SEQ ID NO: 1530 - DNA, 25 bp, Artificial Sequence
  Synthetic oligonucleotide
gccgucuuaauuugguccagcguaa

SEQ ID NO: 1531 - DNA, 25 bp, Artificial Sequence
  Synthetic oligonucleotide
ccgucuuaauuugguccagcguaac

SEQ ID NO: 1532 - DNA, 25 bp, Artificial Sequence
  Synthetic oligonucleotide
cgucuuaauuugguccagcguaacg

SEQ ID NO: 1533 - DNA, 25 bp, Artificial Sequence
  Synthetic oligonucleotide
gucuuaauuugguccagcguaacgt

SEQ ID NO: 1534 - DNA, 25 bp, Artificial Sequence
  Synthetic oligonucleotide
ucuuaauuugguccagcguaacgtg

SEQ ID NO: 1535 - DNA, 25 bp, Artificial Sequence
  Synthetic oligonucleotide
cuuaauuugguccagcguaacguga

SEQ ID NO: 1536 - DNA, 25 bp, Artificial Sequence
  Synthetic oligonucleotide
uuaauuugguccagcguaacgugaa

SEQ ID NO: 1537 - DNA, 25 bp, Artificial Sequence
  Synthetic oligonucleotide
uaauuugguccagcguaacgugaac

SEQ ID NO: 1538 - DNA, 25 bp, Artificial Sequence
  Synthetic oligonucleotide
aauuugguccagcguaacgugaaca

SEQ ID NO: 1539 - DNA, 25 bp, Artificial Sequence
  Synthetic oligonucleotide
auuugguccagcguaacgugaacat

SEQ ID NO: 1540 - DNA, 25 bp, Artificial Sequence
  Synthetic oligonucleotide
uuugguccagcguaacgugaacatc

SEQ ID NO: 1541 - DNA, 25 bp, Artificial Sequence
  Synthetic oligonucleotide
uugguccagcguaacgugaacauct

SEQ ID NO: 1542 - DNA, 25 bp, Artificial Sequence
  Synthetic oligonucleotide
ugguccagcguaacgugaacauctt

SEQ ID NO: 1543 - DNA, 25 bp, Artificial Sequence
  Synthetic oligonucleotide
gguccagcguaacgugaacaucutt

SEQ ID NO: 1544 - DNA, 25 bp, Artificial Sequence
  Synthetic oligonucleotide
guccagcguaacgugaacaucuuta

SEQ ID NO: 1545 - DNA, 25 bp, Artificial Sequence
  Synthetic oligonucleotide
uccagcguaacgugaacaucuuuaa

SEQ ID NO: 1546 - DNA, 25 bp, Artificial Sequence
  Synthetic oligonucleotide
ccagcguaacgugaacaucuuuaaa

SEQ ID NO: 1547 - DNA, 25 bp, Artificial Sequence
  Synthetic oligonucleotide
cagcguaacgugaacaucuuuaaat

SEQ ID NO: 1548 - DNA, 25 bp, Artificial Sequence
  Synthetic oligonucleotide
agcguaacgugaacaucuuuaaatt

SEQ ID NO: 1549 - DNA, 25 bp, Artificial Sequence
  Synthetic oligonucleotide
gcguaacgugaacaucuuuaaautc

SEQ ID NO: 1550 - DNA, 25 bp, Artificial Sequence
  Synthetic oligonucleotide
cguaacgugaacaucuuuaaauuca

SEQ ID NO: 1551 - DNA, 25 bp, Artificial Sequence
  Synthetic oligonucleotide
guaacgugaacaucuuuaaauucat

SEQ ID NO: 1552 - DNA, 25 bp, Artificial Sequence
  Synthetic oligonucleotide
uaacgugaacaucuuuaaauucatc

SEQ ID NO: 1553 - DNA, 25 bp, Artificial Sequence
  Synthetic oligonucleotide
aacgugaacaucuuuaaauucauca

SEQ ID NO: 1554 - DNA, 25 bp, Artificial Sequence
  Synthetic oligonucleotide
acgugaacaucuuuaaauucaucat

SEQ ID NO: 1555 - DNA, 25 bp, Artificial Sequence
  Synthetic oligonucleotide
cgugaacaucuuuaaauucaucatt

SEQ ID NO: 1556 - DNA, 25 bp, Artificial Sequence
  Synthetic oligonucleotide
gugaacaucuuuaaauucaucautc

SEQ ID NO: 1557 - DNA, 25 bp, Artificial Sequence
  Synthetic oligonucleotide
ugaacaucuuuaaauucaucauucc

SEQ ID NO: 1558 - DNA, 25 bp, Artificial Sequence
  Synthetic oligonucleotide
gaacaucuuuaaauucaucauucct

SEQ ID NO: 1559 - DNA, 25 bp, Artificial Sequence
  Synthetic oligonucleotide
aacaucuuuaaauucaucauuccta

SEQ ID NO: 1560 - DNA, 25 bp, Artificial Sequence
  Synthetic oligonucleotide
acaucuuuaaauucaucauuccuaa

SEQ ID NO: 1561 - DNA, 25 bp, Artificial Sequence
  Synthetic oligonucleotide
caucuuuaaauucaucauuccuaat

SEQ ID NO: 1562 - DNA, 25 bp, Artificial Sequence
  Synthetic oligonucleotide
aucuuuaaauucaucauuccuaatg

SEQ ID NO: 1563 - DNA, 25 bp, Artificial Sequence
  Synthetic oligonucleotide
ucuuuaaauucaucauuccuaaugt

SEQ ID NO: 1564 - DNA, 25 bp, Artificial Sequence
  Synthetic oligonucleotide
cuuuaaauucaucauuccuaaugtt

SEQ ID NO: 1565 - DNA, 25 bp, Artificial Sequence
  Synthetic oligonucleotide
uuuaaauucaucauuccuaaugutg

SEQ ID NO: 1566 - DNA, 25 bp, Artificial Sequence
  Synthetic oligonucleotide
uuaaauucaucauuccuaauguugt

SEQ ID NO: 1567 - DNA, 25 bp, Artificial Sequence
  Synthetic oligonucleotide
uaaauucaucauuccuaauguugta

SEQ ID NO: 1568 - DNA, 25 bp, Artificial Sequence
  Synthetic oligonucleotide
aaauucaucauuccuaauguuguaa

SEQ ID NO: 1569 - DNA, 25 bp, Artificial Sequence
  Synthetic oligonucleotide
aauucaucauuccuaauguuguaaa

SEQ ID NO: 1570 - DNA, 25 bp, Artificial Sequence
  Synthetic oligonucleotide
auucaucauuccuaauguuguaaaa

SEQ ID NO: 1571 - DNA, 25 bp, Artificial Sequence
  Synthetic oligonucleotide
uucaucauuccuaauguuguaaaat

SEQ ID NO: 1572 - DNA, 25 bp, Artificial Sequence
  Synthetic oligonucleotide
ucaucauuccuaauguuguaaaata

SEQ ID NO: 1573 - DNA, 25 bp, Artificial Sequence
  Synthetic oligonucleotide
caucauuccuaauguuguaaaauac

SEQ ID NO: 1574 - DNA, 25 bp, Artificial Sequence
  Synthetic oligonucleotide
aucauuccuaauguuguaaaauaca

SEQ ID NO: 1575 - DNA, 25 bp, Artificial Sequence
  Synthetic oligonucleotide
ucauuccuaauguuguaaaauacag

SEQ ID NO: 1576 - DNA, 25 bp, Artificial Sequence
  Synthetic oligonucleotide
cauuccuaauguuguaaaauacagc

SEQ ID NO: 1577 - DNA, 25 bp, Artificial Sequence
  Synthetic oligonucleotide
auuccuaauguuguaaaauacagcc

SEQ ID NO: 1578 - DNA, 25 bp, Artificial Sequence
  Synthetic oligonucleotide
uuccuaauguuguaaaauacagccc

SEQ ID NO: 1579 - DNA, 25 bp, Artificial Sequence
  Synthetic oligonucleotide
uccuaauguuguaaaauacagcccg

SEQ ID NO: 1580 - DNA, 25 bp, Artificial Sequence
  Synthetic oligonucleotide
ccuaauguuguaaaauacagcccga

SEQ ID NO: 1581 - DNA, 25 bp, Artificial Sequence
  Synthetic oligonucleotide
cuaauguuguaaaauacagcccgaa

SEQ ID NO: 1582 - DNA, 25 bp, Artificial Sequence
  Synthetic oligonucleotide
uaauguuguaaaauacagcccgaac

SEQ ID NO: 1583 - DNA, 25 bp, Artificial Sequence
  Synthetic oligonucleotide
aauguuguaaaauacagcccgaact

SEQ ID NO: 1584 - DNA, 25 bp, Artificial Sequence
  Synthetic oligonucleotide
auguuguaaaauacagcccgaactg

SEQ ID NO: 1585 - DNA, 25 bp, Artificial Sequence
  Synthetic oligonucleotide
uguuguaaaauacagcccgaacugc

SEQ ID NO: 1586 - DNA, 25 bp, Artificial Sequence
  Synthetic oligonucleotide
guuguaaaauacagcccgaacugca

SEQ ID NO: 1587 - DNA, 25 bp, Artificial Sequence
  Synthetic oligonucleotide
uuguaaaauacagcccgaacugcaa

SEQ ID NO: 1588 - DNA, 25 bp, Artificial Sequence
  Synthetic oligonucleotide
uguaaaauacagcccgaacugcaag

SEQ ID NO: 1589 - DNA, 25 bp, Artificial Sequence
  Synthetic oligonucleotide
guaaaauacagcccgaacugcaagt

SEQ ID NO: 1590 - DNA, 25 bp, Artificial Sequence
  Synthetic oligonucleotide
uaaaauacagcccgaacugcaagtt

SEQ ID NO: 1591 - DNA, 25 bp, Artificial Sequence
  Synthetic oligonucleotide
aaaauacagcccgaacugcaagutg

SEQ ID NO: 1592 - DNA, 25 bp, Artificial Sequence
  Synthetic oligonucleotide
aaauacagcccgaacugcaaguugc

SEQ ID NO: 1593 - DNA, 25 bp, Artificial Sequence
  Synthetic oligonucleotide
aauacagcccgaacugcaaguugct

SEQ ID NO: 1594 - DNA, 25 bp, Artificial Sequence
  Synthetic oligonucleotide
auacagcccgaacugcaaguugctt

SEQ ID NO: 1595 - DNA, 25 bp, Artificial Sequence
  Synthetic oligonucleotide
uacagcccgaacugcaaguugcuta

SEQ ID NO: 1596 - DNA, 25 bp, Artificial Sequence
  Synthetic oligonucleotide
acagcccgaacugcaaguugcuuat

SEQ ID NO: 1597 - DNA, 25 bp, Artificial Sequence
  Synthetic oligonucleotide
cagcccgaacugcaaguugcuuatt

SEQ ID NO: 1598 - DNA, 25 bp, Artificial Sequence
  Synthetic oligonucleotide
agcccgaacugcaaguugcuuautg

SEQ ID NO: 1599 - DNA, 25 bp, Artificial Sequence
  Synthetic oligonucleotide
gcccgaacugcaaguugcuuauugt

SEQ ID NO: 1600 - DNA, 25 bp, Artificial Sequence
  Synthetic oligonucleotide
cccgaacugcaaguugcuuauugtt

SEQ ID NO: 1601 - DNA, 25 bp, Artificial Sequence
  Synthetic oligonucleotide
ccgaacugcaaguugcuuauugutt

SEQ ID NO: 1602 - DNA, 25 bp, Artificial Sequence
  Synthetic oligonucleotide
cgaacugcaaguugcuuauuguutc

SEQ ID NO: 1603 - DNA, 25 bp, Artificial Sequence
  Synthetic oligonucleotide
gaacugcaaguugcuuauuguuuca

SEQ ID NO: 1604 - DNA, 25 bp, Artificial Sequence
  Synthetic oligonucleotide
aacugcaaguugcuuauuguuucaa

SEQ ID NO: 1605 - DNA, 25 bp, Artificial Sequence
  Synthetic oligonucleotide
acugcaaguugcuuauuguuucaaa

SEQ ID NO: 1606 - DNA, 25 bp, Artificial Sequence
  Synthetic oligonucleotide
cugcaaguugcuuauuguuucaaat

SEQ ID NO: 1607 - DNA, 25 bp, Artificial Sequence
  Synthetic oligonucleotide
ugcaaguugcuuauuguuucaaatc

SEQ ID NO: 1608 - DNA, 25 bp, Artificial Sequence
  Synthetic oligonucleotide
gcaaguugcuuauuguuucaaaucc

SEQ ID NO: 1609 - DNA, 25 bp, Artificial Sequence
  Synthetic oligonucleotide
caaguugcuuauuguuucaaaucca

SEQ ID NO: 1610 - DNA, 25 bp, Artificial Sequence
  Synthetic oligonucleotide
aaguugcuuauuguuucaaauccag

SEQ ID NO: 1611 - DNA, 25 bp, Artificial Sequence
  Synthetic oligonucleotide
aguugcuuauuguuucaaauccagt

SEQ ID NO: 1612 - DNA, 25 bp, Artificial Sequence
  Synthetic oligonucleotide
guugcuuauuguuucaaauccagtg

SEQ ID NO: 1613 - DNA, 25 bp, Artificial Sequence
  Synthetic oligonucleotide
uugcuuauuguuucaaauccagugg

SEQ ID NO: 1614 - DNA, 25 bp, Artificial Sequence
  Synthetic oligonucleotide
ugcuuauuguuucaaauccagugga

SEQ ID NO: 1615 - DNA, 25 bp, Artificial Sequence
  Synthetic oligonucleotide
gcuuauuguuucaaauccaguggat

SEQ ID NO: 1616 - DNA, 25 bp, Artificial Sequence
  Synthetic oligonucleotide
cuuauuguuucaaauccaguggata

SEQ ID NO: 1617 - DNA, 25 bp, Artificial Sequence
  Synthetic oligonucleotide
uuauuguuucaaauccaguggauat

SEQ ID NO: 1618 - DNA, 25 bp, Artificial Sequence
  Synthetic oligonucleotide
uauuguuucaaauccaguggauatc

SEQ ID NO: 1619 - DNA, 25 bp, Artificial Sequence
  Synthetic oligonucleotide
auuguuucaaauccaguggauauct

SEQ ID NO: 1620 - DNA, 25 bp, Artificial Sequence
  Synthetic oligonucleotide
uuguuucaaauccaguggauauctt

SEQ ID NO: 1621 - DNA, 25 bp, Artificial Sequence
  Synthetic oligonucleotide
uguuucaaauccaguggauaucutg

SEQ ID NO: 1622 - DNA, 25 bp, Artificial Sequence
  Synthetic oligonucleotide
guuucaaauccaguggauaucuuga

SEQ ID NO: 1623 - DNA, 25 bp, Artificial Sequence
  Synthetic oligonucleotide
uuucaaauccaguggauaucuugac

SEQ ID NO: 1624 - DNA, 25 bp, Artificial Sequence
  Synthetic oligonucleotide
uucaaauccaguggauaucuugacc

SEQ ID NO: 1625 - DNA, 25 bp, Artificial Sequence
  Synthetic oligonucleotide
ucaaauccaguggauaucuugacct

SEQ ID NO: 1626 - DNA, 25 bp, Artificial Sequence
  Synthetic oligonucleotide
caaauccaguggauaucuugaccta

SEQ ID NO: 1627 - DNA, 25 bp, Artificial Sequence
  Synthetic oligonucleotide
aaauccaguggauaucuugaccuac

SEQ ID NO: 1628 - DNA, 25 bp, Artificial Sequence
  Synthetic oligonucleotide
aauccaguggauaucuugaccuacg

SEQ ID NO: 1629 - DNA, 25 bp, Artificial Sequence
  Synthetic oligonucleotide
auccaguggauaucuugaccuacgt

SEQ ID NO: 1630 - DNA, 25 bp, Artificial Sequence
  Synthetic oligonucleotide
uccaguggauaucuugaccuacgtg

SEQ ID NO: 1631 - DNA, 25 bp, Artificial Sequence
  Synthetic oligonucleotide
ccaguggauaucuugaccuacgugg

SEQ ID NO: 1632 - DNA, 25 bp, Artificial Sequence
  Synthetic oligonucleotide
caguggauaucuugaccuacguggc

SEQ ID NO: 1633 - DNA, 25 bp, Artificial Sequence
  Synthetic oligonucleotide
aguggauaucuugaccuacguggct

SEQ ID NO: 1634 - DNA, 25 bp, Artificial Sequence
  Synthetic oligonucleotide
uggauaucuugaccuacguggcutg

SEQ ID NO: 1635 - DNA, 25 bp, Artificial Sequence
  Synthetic oligonucleotide
ggauaucuugaccuacguggcuugg

SEQ ID NO: 1636 - DNA, 25 bp, Artificial Sequence
  Synthetic oligonucleotide
ucuugaccuacguggcuuggaagat

SEQ ID NO: 1637 - DNA, 25 bp, Artificial Sequence
  Synthetic oligonucleotide
gaccuacguggcuuggaagauaagt

SEQ ID NO: 1638 - DNA, 25 bp, Artificial Sequence
  Synthetic oligonucleotide
accuacguggcuuggaagauaagtg

SEQ ID NO: 1639 - DNA, 25 bp, Artificial Sequence
  Synthetic oligonucleotide
ccuacguggcuuggaagauaagugg

SEQ ID NO: 1640 - DNA, 25 bp, Artificial Sequence
  Synthetic oligonucleotide
cuacguggcuuggaagauaaguggt

SEQ ID NO: 1641 - DNA, 25 bp, Artificial Sequence
  Synthetic oligonucleotide
uacguggcuuggaagauaaguggtt

SEQ ID NO: 1642 - DNA, 25 bp, Artificial Sequence
  Synthetic oligonucleotide
acguggcuuggaagauaaguggutt

SEQ ID NO: 1643 - DNA, 25 bp, Artificial Sequence
  Synthetic oligonucleotide
cguggcuuggaagauaagugguutt

SEQ ID NO: 1644 - DNA, 25 bp, Artificial Sequence
  Synthetic oligonucleotide
guggcuuggaagauaagugguuutc

SEQ ID NO: 1645 - DNA, 25 bp, Artificial Sequence
  Synthetic oligonucleotide
uggcuuggaagauaagugguuuucc

SEQ ID NO: 1646 - DNA, 25 bp, Artificial Sequence
  Synthetic oligonucleotide
ggcuuggaagauaagugguuuuccc

SEQ ID NO: 1647 - DNA, 25 bp, Artificial Sequence
  Synthetic oligonucleotide
gcuuggaagauaagugguuuuccca

SEQ ID NO: 1648 - DNA, 25 bp, Artificial Sequence
  Synthetic oligonucleotide
cuuggaagauaagugguuuucccaa

SEQ ID NO: 1649 - DNA, 25 bp, Artificial Sequence
  Synthetic oligonucleotide
uuggaagauaagugguuuucccaaa

SEQ ID NO: 1650 - DNA, 25 bp, Artificial Sequence
  Synthetic oligonucleotide
uggaagauaagugguuuucccaaaa

SEQ ID NO: 1651 - DNA, 25 bp, Artificial Sequence
  Synthetic oligonucleotide
aagauaagugguuuucccaaaaacc

SEQ ID NO: 1652 - DNA, 25 bp, Artificial Sequence
  Synthetic oligonucleotide
agauaagugguuuucccaaaaaccg

SEQ ID NO: 1653 - DNA, 25 bp, Artificial Sequence
  Synthetic oligonucleotide
gauaagugguuuucccaaaaaccgt

SEQ ID NO: 1654 - DNA, 25 bp, Artificial Sequence
  Synthetic oligonucleotide
auaagugguuuucccaaaaaccgtg

SEQ ID NO: 1655 - DNA, 25 bp, Artificial Sequence
  Synthetic oligonucleotide
uaagugguuuucccaaaaaccgugt

SEQ ID NO: 1656 - DNA, 25 bp, Artificial Sequence
  Synthetic oligonucleotide
aagugguuuucccaaaaaccgugtt

SEQ ID NO: 1657 - DNA, 25 bp, Artificial Sequence
  Synthetic oligonucleotide
agugguuuucccaaaaaccguguta

SEQ ID NO: 1658 - DNA, 25 bp, Artificial Sequence
  Synthetic oligonucleotide
gugguuuucccaaaaaccguguuat

SEQ ID NO: 1659 - DNA, 25 bp, Artificial Sequence
  Synthetic oligonucleotide
ugguuuucccaaaaaccguguuatt

SEQ ID NO: 1660 - DNA, 25 bp, Artificial Sequence
  Synthetic oligonucleotide
gguuuucccaaaaaccguguuautg

SEQ ID NO: 1661 - DNA, 25 bp, Artificial Sequence
  Synthetic oligonucleotide
guuuucccaaaaaccguguuauugg

SEQ ID NO: 1662 - DNA, 25 bp, Artificial Sequence
  Synthetic oligonucleotide
uuuucccaaaaaccguguuauugga

SEQ ID NO: 1663 - DNA, 25 bp, Artificial Sequence
  Synthetic oligonucleotide
uuucccaaaaaccguguuauuggaa

SEQ ID NO: 1664 - DNA, 25 bp, Artificial Sequence
  Synthetic oligonucleotide
uucccaaaaaccguguuauuggaag

SEQ ID NO: 1665 - DNA, 25 bp, Artificial Sequence
  Synthetic oligonucleotide
ucccaaaaaccguguuauuggaagc

SEQ ID NO: 1666 - DNA, 25 bp, Artificial Sequence
  Synthetic oligonucleotide
cccaaaaaccguguuauuggaagcg

SEQ ID NO: 1667 - DNA, 25 bp, Artificial Sequence
  Synthetic oligonucleotide
ccaaaaaccguguuauuggaagcgg

SEQ ID NO: 1668 - DNA, 25 bp, Artificial Sequence
  Synthetic oligonucleotide
caaaaaccguguuauuggaagcggt

SEQ ID NO: 1669 - DNA, 25 bp, Artificial Sequence
  Synthetic oligonucleotide
aaaaaccguguuauuggaagcggtt

SEQ ID NO: 1670 - DNA, 25 bp, Artificial Sequence
  Synthetic oligonucleotide
aaaaccguguuauuggaagcggutg

SEQ ID NO: 1671 - DNA, 25 bp, Artificial Sequence
  Synthetic oligonucleotide
aaaccguguuauuggaagcgguugc

SEQ ID NO: 1672 - DNA, 25 bp, Artificial Sequence
  Synthetic oligonucleotide
aaccguguuauuggaagcgguugca

SEQ ID NO: 1673 - DNA, 25 bp, Artificial Sequence
  Synthetic oligonucleotide
accguguuauuggaagcgguugcaa

SEQ ID NO: 1674 - DNA, 25 bp, Artificial Sequence
  Synthetic oligonucleotide
ccguguuauuggaagcgguugcaat

SEQ ID NO: 1675 - DNA, 25 bp, Artificial Sequence
  Synthetic oligonucleotide
cguguuauuggaagcgguugcaatc

SEQ ID NO: 1676 - DNA, 25 bp, Artificial Sequence
  Synthetic oligonucleotide
guguuauuggaagcgguugcaauct

SEQ ID NO: 1677 - DNA, 25 bp, Artificial Sequence
  Synthetic oligonucleotide
uguuauuggaagcgguugcaauctg

SEQ ID NO: 1678 - DNA, 25 bp, Artificial Sequence
  Synthetic oligonucleotide
guuauuggaagcgguugcaaucugg

SEQ ID NO: 1679 - DNA, 25 bp, Artificial Sequence
  Synthetic oligonucleotide
uuauuggaagcgguugcaaucugga

SEQ ID NO: 1680 - DNA, 25 bp, Artificial Sequence
  Synthetic oligonucleotide
uauuggaagcgguugcaaucuggat

SEQ ID NO: 1681 - DNA, 25 bp, Artificial Sequence
  Synthetic oligonucleotide
auuggaagcgguugcaaucuggatt

SEQ ID NO: 1682 - DNA, 25 bp, Artificial Sequence
  Synthetic oligonucleotide
uuggaagcgguugcaaucuggautc

SEQ ID NO: 1683 - DNA, 25 bp, Artificial Sequence
  Synthetic oligonucleotide
uggaagcgguugcaaucuggauuca

SEQ ID NO: 1684 - DNA, 25 bp, Artificial Sequence
  Synthetic oligonucleotide
ggaagcgguugcaaucuggauucag

SEQ ID NO: 1685 - DNA, 25 bp, Artificial Sequence
  Synthetic oligonucleotide
gaagcgguugcaaucuggauucagc

SEQ ID NO: 1686 - DNA, 25 bp, Artificial Sequence
  Synthetic oligonucleotide
aagcgguugcaaucuggauucagcc

SEQ ID NO: 1687 - DNA, 25 bp, Artificial Sequence
  Synthetic oligonucleotide
agcgguugcaaucuggauucagccc

SEQ ID NO: 1688 - DNA, 25 bp, Artificial Sequence
  Synthetic oligonucleotide
gcgguugcaaucuggauucagcccg

SEQ ID NO: 1689 - DNA, 25 bp, Artificial Sequence
  Synthetic oligonucleotide
cgguugcaaucuggauucagcccga

SEQ ID NO: 1690 - DNA, 25 bp, Artificial Sequence
  Synthetic oligonucleotide
gguugcaaucuggauucagcccgat

SEQ ID NO: 1691 - DNA, 25 bp, Artificial Sequence
  Synthetic oligonucleotide
guugcaaucuggauucagcccgatt

SEQ ID NO: 1692 - DNA, 25 bp, Artificial Sequence
  Synthetic oligonucleotide
uugcaaucuggauucagcccgautc

SEQ ID NO: 1693 - DNA, 25 bp, Artificial Sequence
  Synthetic oligonucleotide
ugcaaucuggauucagcccgauucc

SEQ ID NO: 1694 - DNA, 25 bp, Artificial Sequence
  Synthetic oligonucleotide
gcaaucuggauucagcccgauuccg

SEQ ID NO: 1695 - DNA, 25 bp, Artificial Sequence
  Synthetic oligonucleotide
caaucuggauucagcccgauuccgt

SEQ ID NO: 1696 - DNA, 25 bp, Artificial Sequence
  Synthetic oligonucleotide
aaucuggauucagcccgauuccgtt

SEQ ID NO: 1697 - DNA, 25 bp, Artificial Sequence
  Synthetic oligonucleotide
aucuggauucagcccgauuccguta

SEQ ID NO: 1698 - DNA, 25 bp, Artificial Sequence
  Synthetic oligonucleotide
ucuggauucagcccgauuccguuac

SEQ ID NO: 1699 - DNA, 25 bp, Artificial Sequence
  Synthetic oligonucleotide
cuggauucagcccgauuccguuacc

SEQ ID NO: 1700 - DNA, 25 bp, Artificial Sequence
  Synthetic oligonucleotide
uggauucagcccgauuccguuacct

SEQ ID NO: 1701 - DNA, 25 bp, Artificial Sequence
  Synthetic oligonucleotide
ggauucagcccgauuccguuaccta

SEQ ID NO: 1702 - DNA, 25 bp, Artificial Sequence
  Synthetic oligonucleotide
gauucagcccgauuccguuaccuaa

SEQ ID NO: 1703 - DNA, 25 bp, Artificial Sequence
  Synthetic oligonucleotide
auucagcccgauuccguuaccuaat

SEQ ID NO: 1704 - DNA, 25 bp, Artificial Sequence
  Synthetic oligonucleotide
uucagcccgauuccguuaccuaatg

SEQ ID NO: 1705 - DNA, 25 bp, Artificial Sequence
  Synthetic oligonucleotide
ucagcccgauuccguuaccuaaugg

SEQ ID NO: 1706 - DNA, 25 bp, Artificial Sequence
  Synthetic oligonucleotide
cagcccgauuccguuaccuaauggg

SEQ ID NO: 1707 - DNA, 25 bp, Artificial Sequence
  Synthetic oligonucleotide
agcccgauuccguuaccuaaugggg

SEQ ID NO: 1708 - DNA, 25 bp, Artificial Sequence
  Synthetic oligonucleotide
gcccgauuccguuaccuaauggggg

SEQ ID NO: 1709 - DNA, 25 bp, Artificial Sequence
  Synthetic oligonucleotide
cccgauuccguuaccuaauggggga

SEQ ID NO: 1710 - DNA, 25 bp, Artificial Sequence
  Synthetic oligonucleotide
ccgauuccguuaccuaaugggggaa

SEQ ID NO: 1711 - DNA, 25 bp, Artificial Sequence
  Synthetic oligonucleotide
cgauuccguuaccuaaugggggaaa

SEQ ID NO: 1712 - DNA, 25 bp, Artificial Sequence
  Synthetic oligonucleotide
gauuccguuaccuaaugggggaaag

SEQ ID NO: 1713 - DNA, 25 bp, Artificial Sequence
  Synthetic oligonucleotide
auuccguuaccuaaugggggaaagg

SEQ ID NO: 1714 - DNA, 25 bp, Artificial Sequence
  Synthetic oligonucleotide
uuccguuaccuaaugggggaaaggc

SEQ ID NO: 1715 - DNA, 25 bp, Artificial Sequence
  Synthetic oligonucleotide
uccguuaccuaaugggggaaaggct

SEQ ID NO: 1716 - DNA, 25 bp, Artificial Sequence
  Synthetic oligonucleotide
ccguuaccuaaugggggaaaggctg

SEQ ID NO: 1717 - DNA, 25 bp, Artificial Sequence
  Synthetic oligonucleotide
cguuaccuaaugggggaaaggcugg

SEQ ID NO: 1718 - DNA, 25 bp, Artificial Sequence
  Synthetic oligonucleotide
guuaccuaaugggggaaaggcuggg

SEQ ID NO: 1719 - DNA, 25 bp, Artificial Sequence
  Synthetic oligonucleotide
uuaccuaaugggggaaaggcuggga

SEQ ID NO: 1720 - DNA, 25 bp, Artificial Sequence
  Synthetic oligonucleotide
uaccuaaugggggaaaggcugggag

SEQ ID NO: 1721 - DNA, 25 bp, Artificial Sequence
  Synthetic oligonucleotide
accuaaugggggaaaggcugggagt

SEQ ID NO: 1722 - DNA, 25 bp, Artificial Sequence
  Synthetic oligonucleotide
ccuaaugggggaaaggcugggagtt

SEQ ID NO: 1723 - DNA, 25 bp, Artificial Sequence
  Synthetic oligonucleotide
cuaaugggggaaaggcugggagutc

SEQ ID NO: 1724 - DNA, 25 bp, Artificial Sequence
  Synthetic oligonucleotide
uaaugggggaaaggcugggaguuca

SEQ ID NO: 1725 - DNA, 25 bp, Artificial Sequence
  Synthetic oligonucleotide
aaugggggaaaggcugggaguucac

SEQ ID NO: 1726 - DNA, 25 bp, Artificial Sequence
  Synthetic oligonucleotide
augggggaaaggcugggaguucacc

SEQ ID NO: 1727 - DNA, 25 bp, Artificial Sequence
  Synthetic oligonucleotide
ugggggaaaggcugggaguucaccc

SEQ ID NO: 1728 - DNA, 25 bp, Artificial Sequence
  Synthetic oligonucleotide
gggggaaaggcugggaguucaccca

SEQ ID NO: 1729 - DNA, 25 bp, Artificial Sequence
  Synthetic oligonucleotide
ggggaaaggcugggaguucacccat

SEQ ID NO: 1730 - DNA, 25 bp, Artificial Sequence
  Synthetic oligonucleotide
gggaaaggcugggaguucacccatt

SEQ ID NO: 1731 - DNA, 25 bp, Artificial Sequence
  Synthetic oligonucleotide
ggaaaggcugggaguucacccauta

SEQ ID NO: 1732 - DNA, 25 bp, Artificial Sequence
  Synthetic oligonucleotide
gaaaggcugggaguucacccauuaa

SEQ ID NO: 1733 - DNA, 25 bp, Artificial Sequence
  Synthetic oligonucleotide
aaaggcugggaguucacccauuaag

SEQ ID NO: 1734 - DNA, 25 bp, Artificial Sequence
  Synthetic oligonucleotide
aaggcugggaguucacccauuaagc

SEQ ID NO: 1735 - DNA, 25 bp, Artificial Sequence
  Synthetic oligonucleotide
aggcugggaguucacccauuaagct

SEQ ID NO: 1736 - DNA, 25 bp, Artificial Sequence
  Synthetic oligonucleotide
ggcugggaguucacccauuaagctg

SEQ ID NO: 1737 - DNA, 25 bp, Artificial Sequence
  Synthetic oligonucleotide
gcugggaguucacccauuaagcugt

SEQ ID NO: 1738 - DNA, 25 bp, Artificial Sequence
  Synthetic oligonucleotide
cugggaguucacccauuaagcugtc

SEQ ID NO: 1739 - DNA, 25 bp, Artificial Sequence
  Synthetic oligonucleotide
ugggaguucacccauuaagcuguca

SEQ ID NO: 1740 - DNA, 25 bp, Artificial Sequence
  Synthetic oligonucleotide
gggaguucacccauuaagcugucat

SEQ ID NO: 1741 - DNA, 25 bp, Artificial Sequence
  Synthetic oligonucleotide
ggaguucacccauuaagcugucatg

SEQ ID NO: 1742 - DNA, 25 bp, Artificial Sequence
  Synthetic oligonucleotide
gaguucacccauuaagcugucaugg

SEQ ID NO: 1743 - DNA, 25 bp, Artificial Sequence
  Synthetic oligonucleotide
aguucacccauuaagcugucauggg

SEQ ID NO: 1744 - DNA, 25 bp, Artificial Sequence
  Synthetic oligonucleotide
guucacccauuaagcugucaugggt

SEQ ID NO: 1745 - DNA, 25 bp, Artificial Sequence
  Synthetic oligonucleotide
uucacccauuaagcugucaugggtg

SEQ ID NO: 1746 - DNA, 25 bp, Artificial Sequence
  Synthetic oligonucleotide
ucacccauuaagcugucaugggugg

SEQ ID NO: 1747 - DNA, 25 bp, Artificial Sequence
  Synthetic oligonucleotide
cacccauuaagcugucauggguggg

SEQ ID NO: 1748 - DNA, 25 bp, Artificial Sequence
  Synthetic oligonucleotide
acccauuaagcugucaugggugggt

SEQ ID NO: 1749 - DNA, 25 bp, Artificial Sequence
  Synthetic oligonucleotide
cccauuaagcugucaugggugggtc

SEQ ID NO: 1750 - DNA, 25 bp, Artificial Sequence
  Synthetic oligonucleotide
ccauuaagcugucaugggugggucc

SEQ ID NO: 1751 - DNA, 25 bp, Artificial Sequence
  Synthetic oligonucleotide
cauuaagcugucaugggugggucct

SEQ ID NO: 1752 - DNA, 25 bp, Artificial Sequence
  Synthetic oligonucleotide
auuaagcugucaugggugggucctt

SEQ ID NO: 1753 - DNA, 25 bp, Artificial Sequence
  Synthetic oligonucleotide
uuaagcugucauggguggguccutg

SEQ ID NO: 1754 - DNA, 25 bp, Artificial Sequence
  Synthetic oligonucleotide
uaagcugucauggguggguccuugg

SEQ ID NO: 1755 - DNA, 25 bp, Artificial Sequence
  Synthetic oligonucleotide
aagcugucauggguggguccuuggg

SEQ ID NO: 1756 - DNA, 25 bp, Artificial Sequence
  Synthetic oligonucleotide
agcugucauggguggguccuugggg

SEQ ID NO: 1757 - DNA, 25 bp, Artificial Sequence
  Synthetic oligonucleotide
gcugucauggguggguccuugggga

SEQ ID NO: 1758 - DNA, 25 bp, Artificial Sequence
  Synthetic oligonucleotide
cugucauggguggguccuuggggaa

SEQ ID NO: 1759 - DNA, 25 bp, Artificial Sequence
  Synthetic oligonucleotide
ugucauggguggguccuuggggaac

SEQ ID NO: 1760 - DNA, 25 bp, Artificial Sequence
  Synthetic oligonucleotide
gucauggguggguccuuggggaaca

SEQ ID NO: 1761 - DNA, 25 bp, Artificial Sequence
  Synthetic oligonucleotide
ucauggguggguccuuggggaacat

SEQ ID NO: 1762 - DNA, 25 bp, Artificial Sequence
  Synthetic oligonucleotide
cauggguggguccuuggggaacatg

SEQ ID NO: 1763 - DNA, 25 bp, Artificial Sequence
  Synthetic oligonucleotide
auggguggguccuuggggaacaugg

SEQ ID NO: 1764 - DNA, 25 bp, Artificial Sequence
  Synthetic oligonucleotide
uggguggguccuuggggaacaugga

SEQ ID NO: 1765 - DNA, 25 bp, Artificial Sequence
  Synthetic oligonucleotide
ggguggguccuuggggaacauggag

SEQ ID NO: 1766 - DNA, 25 bp, Artificial Sequence
  Synthetic oligonucleotide
gguggguccuuggggaacauggaga

SEQ ID NO: 1767 - DNA, 25 bp, Artificial Sequence
  Synthetic oligonucleotide
guggguccuuggggaacauggagat

SEQ ID NO: 1768 - DNA, 25 bp, Artificial Sequence
  Synthetic oligonucleotide
uggguccuuggggaacauggagatt

SEQ ID NO: 1769 - DNA, 25 bp, Artificial Sequence
  Synthetic oligonucleotide
ggguccuuggggaacauggagautc

SEQ ID NO: 1770 - DNA, 25 bp, Artificial Sequence
  Synthetic oligonucleotide
gguccuuggggaacauggagauucc

SEQ ID NO: 1771 - DNA, 25 bp, Artificial Sequence
  Synthetic oligonucleotide
guccuuggggaacauggagauucca

SEQ ID NO: 1772 - DNA, 25 bp, Artificial Sequence
  Synthetic oligonucleotide
uccuuggggaacauggagauuccag

SEQ ID NO: 1773 - DNA, 25 bp, Artificial Sequence
  Synthetic oligonucleotide
ccuuggggaacauggagauuccagt

SEQ ID NO: 1774 - DNA, 25 bp, Artificial Sequence
  Synthetic oligonucleotide
cuuggggaacauggagauuccagtg

SEQ ID NO: 1775 - DNA, 25 bp, Artificial Sequence
  Synthetic oligonucleotide
uuggggaacauggagauuccagugt

SEQ ID NO: 1776 - DNA, 25 bp, Artificial Sequence
  Synthetic oligonucleotide
uggggaacauggagauuccagugtg

SEQ ID NO: 1777 - DNA, 25 bp, Artificial Sequence
  Synthetic oligonucleotide
ggggaacauggagauuccagugugc

SEQ ID NO: 1778 - DNA, 25 bp, Artificial Sequence
  Synthetic oligonucleotide
gggaacauggagauuccagugugcc

SEQ ID NO: 1779 - DNA, 25 bp, Artificial Sequence
  Synthetic oligonucleotide
ggaacauggagauuccagugugcct

SEQ ID NO: 1780 - DNA, 25 bp, Artificial Sequence
  Synthetic oligonucleotide
gaacauggagauuccagugugcctg

SEQ ID NO: 1781 - DNA, 25 bp, Artificial Sequence
  Synthetic oligonucleotide
aacauggagauuccagugugccugt

SEQ ID NO: 1782 - DNA, 25 bp, Artificial Sequence
  Synthetic oligonucleotide
acauggagauuccagugugccugta

SEQ ID NO: 1783 - DNA, 25 bp, Artificial Sequence
  Synthetic oligonucleotide
cauggagauuccagugugccuguat

SEQ ID NO: 1784 - DNA, 25 bp, Artificial Sequence
  Synthetic oligonucleotide
auggagauuccagugugccuguatg

SEQ ID NO: 1785 - DNA, 25 bp, Artificial Sequence
  Synthetic oligonucleotide
uggagauuccagugugccuguaugg

SEQ ID NO: 1786 - DNA, 25 bp, Artificial Sequence
  Synthetic oligonucleotide
ggagauuccagugugccuguaugga

SEQ ID NO: 1787 - DNA, 25 bp, Artificial Sequence
  Synthetic oligonucleotide
gagauuccagugugccuguauggag

SEQ ID NO: 1788 - DNA, 25 bp, Artificial Sequence
  Synthetic oligonucleotide
agauuccagugugccuguauggagt

SEQ ID NO: 1789 - DNA, 25 bp, Artificial Sequence
  Synthetic oligonucleotide
gauuccagugugccuguauggagtg

SEQ ID NO: 1790 - DNA, 25 bp, Artificial Sequence
  Synthetic oligonucleotide
auuccagugugccuguauggagugg

SEQ ID NO: 1791 - DNA, 25 bp, Artificial Sequence
  Synthetic oligonucleotide
uuccagugugccuguauggagugga

SEQ ID NO: 1792 - DNA, 25 bp, Artificial Sequence
  Synthetic oligonucleotide
uccagugugccuguauggaguggaa

SEQ ID NO: 1793 - DNA, 25 bp, Artificial Sequence
  Synthetic oligonucleotide
ccagugugccuguauggaguggaat

SEQ ID NO: 1794 - DNA, 25 bp, Artificial Sequence
  Synthetic oligonucleotide
cagugugccuguauggaguggaatg

SEQ ID NO: 1795 - DNA, 25 bp, Artificial Sequence
  Synthetic oligonucleotide
agugugccuguauggaguggaauga

SEQ ID NO: 1796 - DNA, 25 bp, Artificial Sequence
  Synthetic oligonucleotide
gugugccuguauggaguggaaugaa

SEQ ID NO: 1797 - DNA, 25 bp, Artificial Sequence
  Synthetic oligonucleotide
ugugccuguauggaguggaaugaat

SEQ ID NO: 1798 - DNA, 25 bp, Artificial Sequence
  Synthetic oligonucleotide
gugccuguauggaguggaaugaatg

SEQ ID NO: 1799 - DNA, 25 bp, Artificial Sequence
  Synthetic oligonucleotide
ugccuguauggaguggaaugaaugt

SEQ ID NO: 1800 - DNA, 25 bp, Artificial Sequence
  Synthetic oligonucleotide
gccuguauggaguggaaugaaugtt

SEQ ID NO: 1801 - DNA, 25 bp, Artificial Sequence
  Synthetic oligonucleotide
uguauggaguggaaugaauguugct

SEQ ID NO: 1802 - DNA, 25 bp, Artificial Sequence
  Synthetic oligonucleotide
guauggaguggaaugaauguugctg

SEQ ID NO: 1803 - DNA, 25 bp, Artificial Sequence
  Synthetic oligonucleotide
uauggaguggaaugaauguugcugg

SEQ ID NO: 1804 - DNA, 25 bp, Artificial Sequence
  Synthetic oligonucleotide
auggaguggaaugaauguugcuggt

SEQ ID NO: 1805 - DNA, 25 bp, Artificial Sequence
  Synthetic oligonucleotide
uggaguggaaugaauguugcuggtg

SEQ ID NO: 1806 - DNA, 25 bp, Artificial Sequence
  Synthetic oligonucleotide
ggaguggaaugaauguugcuggugt

SEQ ID NO: 1807 - DNA, 25 bp, Artificial Sequence
  Synthetic oligonucleotide
gaguggaaugaauguugcuggugtc

SEQ ID NO: 1808 - DNA, 25 bp, Artificial Sequence
  Synthetic oligonucleotide
aguggaaugaauguugcugguguct

SEQ ID NO: 1809 - DNA, 25 bp, Artificial Sequence
  Synthetic oligonucleotide
guggaaugaauguugcugguguctc

SEQ ID NO: 1810 - DNA, 25 bp, Artificial Sequence
  Synthetic oligonucleotide
uggaaugaauguugcuggugucuct

SEQ ID NO: 1811 - DNA, 25 bp, Artificial Sequence
  Synthetic oligonucleotide
ggaaugaauguugcuggugucuctc

SEQ ID NO: 1812 - DNA, 25 bp, Artificial Sequence
  Synthetic oligonucleotide
gaaugaauguugcuggugucucuct

SEQ ID NO: 1813 - DNA, 25 bp, Artificial Sequence
  Synthetic oligonucleotide
aaugaauguugcuggugucucuctg

SEQ ID NO: 1814 - DNA, 25 bp, Artificial Sequence
  Synthetic oligonucleotide
augaauguugcuggugucucucuga

SEQ ID NO: 1815 - DNA, 25 bp, Artificial Sequence
  Synthetic oligonucleotide
gaauguugcuggugucucucugaag

SEQ ID NO: 1816 - DNA, 25 bp, Artificial Sequence
  Synthetic oligonucleotide
aauguugcuggugucucucugaaga

SEQ ID NO: 1817 - DNA, 25 bp, Artificial Sequence
  Synthetic oligonucleotide
auguugcuggugucucucugaagac

SEQ ID NO: 1818 - DNA, 25 bp, Artificial Sequence
  Synthetic oligonucleotide
uguugcuggugucucucugaagact

SEQ ID NO: 1819 - DNA, 25 bp, Artificial Sequence
  Synthetic oligonucleotide
guugcuggugucucucugaagactc

SEQ ID NO: 1820 - DNA, 25 bp, Artificial Sequence
  Synthetic oligonucleotide
uugcuggugucucucugaagacuct

SEQ ID NO: 1821 - DNA, 25 bp, Artificial Sequence
  Synthetic oligonucleotide
ugcuggugucucucugaagacuctg

SEQ ID NO: 1822 - DNA, 25 bp, Artificial Sequence
  Synthetic oligonucleotide
gcuggugucucucugaagacucugc

SEQ ID NO: 1823 - DNA, 25 bp, Artificial Sequence
  Synthetic oligonucleotide
cuggugucucucugaagacucugca

SEQ ID NO: 1824 - DNA, 25 bp, Artificial Sequence
  Synthetic oligonucleotide
uggugucucucugaagacucugcac

SEQ ID NO: 1825 - DNA, 25 bp, Artificial Sequence
  Synthetic oligonucleotide
ggugucucucugaagacucugcacc

SEQ ID NO: 1826 - DNA, 25 bp, Artificial Sequence
  Synthetic oligonucleotide
gugucucucugaagacucugcaccc

SEQ ID NO: 1827 - DNA, 25 bp, Artificial Sequence
  Synthetic oligonucleotide
ugucucucugaagacucugcaccca

SEQ ID NO: 1828 - DNA, 25 bp, Artificial Sequence
  Synthetic oligonucleotide
gucucucugaagacucugcacccag

SEQ ID NO: 1829 - DNA, 25 bp, Artificial Sequence
  Synthetic oligonucleotide
ucucucugaagacucugcacccaga

SEQ ID NO: 1830 - DNA, 25 bp, Artificial Sequence
  Synthetic oligonucleotide
cucucugaagacucugcacccagat

SEQ ID NO: 1831 - DNA, 25 bp, Artificial Sequence
  Synthetic oligonucleotide
ucucugaagacucugcacccagatt

SEQ ID NO: 1832 - DNA, 25 bp, Artificial Sequence
  Synthetic oligonucleotide
cucugaagacucugcacccagautt

SEQ ID NO: 1833 - DNA, 25 bp, Artificial Sequence
  Synthetic oligonucleotide
ucugaagacucugcacccagauuta

SEQ ID NO: 1834 - DNA, 25 bp, Artificial Sequence
  Synthetic oligonucleotide
cugaagacucugcacccagauuuag

SEQ ID NO: 1835 - DNA, 25 bp, Artificial Sequence
  Synthetic oligonucleotide
ugaagacucugcacccagauuuagg

SEQ ID NO: 1836 - DNA, 25 bp, Artificial Sequence
  Synthetic oligonucleotide
gaagacucugcacccagauuuaggg

SEQ ID NO: 1837 - DNA, 25 bp, Artificial Sequence
  Synthetic oligonucleotide
aagacucugcacccagauuuaggga

SEQ ID NO: 1838 - DNA, 25 bp, Artificial Sequence
  Synthetic oligonucleotide
agacucugcacccagauuuagggac

SEQ ID NO: 1839 - DNA, 25 bp, Artificial Sequence
  Synthetic oligonucleotide
gacucugcacccagauuuagggact

SEQ ID NO: 1840 - DNA, 25 bp, Artificial Sequence
  Synthetic oligonucleotide
acucugcacccagauuuagggactg

SEQ ID NO: 1841 - DNA, 25 bp, Artificial Sequence
  Synthetic oligonucleotide
cucugcacccagauuuagggacuga

SEQ ID NO: 1842 - DNA, 25 bp, Artificial Sequence
  Synthetic oligonucleotide
ucugcacccagauuuagggacugat

SEQ ID NO: 1843 - DNA, 25 bp, Artificial Sequence
  Synthetic oligonucleotide
cugcacccagauuuagggacugata

SEQ ID NO: 1844 - DNA, 25 bp, Artificial Sequence
  Synthetic oligonucleotide
ugcacccagauuuagggacugauaa

SEQ ID NO: 1845 - DNA, 25 bp, Artificial Sequence
  Synthetic oligonucleotide
gcacccagauuuagggacugauaaa

SEQ ID NO: 1846 - DNA, 25 bp, Artificial Sequence
  Synthetic oligonucleotide
cacccagauuuagggacugauaaag

SEQ ID NO: 1847 - DNA, 25 bp, Artificial Sequence
  Synthetic oligonucleotide
acccagauuuagggacugauaaaga

SEQ ID NO: 1848 - DNA, 25 bp, Artificial Sequence
  Synthetic oligonucleotide
cccagauuuagggacugauaaagat

SEQ ID NO: 1849 - DNA, 25 bp, Artificial Sequence
  Synthetic oligonucleotide
ccagauuuagggacugauaaagata

SEQ ID NO: 1850 - DNA, 25 bp, Artificial Sequence
  Synthetic oligonucleotide
cagauuuagggacugauaaagauaa

SEQ ID NO: 1851 - DNA, 25 bp, Artificial Sequence
  Synthetic oligonucleotide
agauuuagggacugauaaagauaag

SEQ ID NO: 1852 - DNA, 25 bp, Artificial Sequence
  Synthetic oligonucleotide
gauuuagggacugauaaagauaagg

SEQ ID NO: 1853 - DNA, 25 bp, Artificial Sequence
  Synthetic oligonucleotide
auuuagggacugauaaagauaagga

SEQ ID NO: 1854 - DNA, 25 bp, Artificial Sequence
  Synthetic oligonucleotide
uuuagggacugauaaagauaaggaa

SEQ ID NO: 1855 - DNA, 25 bp, Artificial Sequence
  Synthetic oligonucleotide
uuagggacugauaaagauaaggaac

SEQ ID NO: 1856 - DNA, 25 bp, Artificial Sequence
  Synthetic oligonucleotide
uagggacugauaaagauaaggaaca

SEQ ID NO: 1857 - DNA, 25 bp, Artificial Sequence
  Synthetic oligonucleotide
agggacugauaaagauaaggaacag

SEQ ID NO: 1858 - DNA, 25 bp, Artificial Sequence
  Synthetic oligonucleotide
gggacugauaaagauaaggaacagt

SEQ ID NO: 1859 - DNA, 25 bp, Artificial Sequence
  Synthetic oligonucleotide
gacugauaaagauaaggaacagugg

SEQ ID NO: 1860 - DNA, 25 bp, Artificial Sequence
  Synthetic oligonucleotide
acugauaaagauaaggaacagugga

SEQ ID NO: 1861 - DNA, 25 bp, Artificial Sequence
  Synthetic oligonucleotide
cugauaaagauaaggaacaguggaa

SEQ ID NO: 1862 - DNA, 25 bp, Artificial Sequence
  Synthetic oligonucleotide
ugauaaagauaaggaacaguggaaa

SEQ ID NO: 1863 - DNA, 25 bp, Artificial Sequence
  Synthetic oligonucleotide
gauaaagauaaggaacaguggaaag

SEQ ID NO: 1864 - DNA, 25 bp, Artificial Sequence
  Synthetic oligonucleotide
auaaagauaaggaacaguggaaaga

SEQ ID NO: 1865 - DNA, 25 bp, Artificial Sequence
  Synthetic oligonucleotide
uaaagauaaggaacaguggaaagag

SEQ ID NO: 1866 - DNA, 25 bp, Artificial Sequence
  Synthetic oligonucleotide
aaagauaaggaacaguggaaagagg

SEQ ID NO: 1867 - DNA, 25 bp, Artificial Sequence
  Synthetic oligonucleotide
aagauaaggaacaguggaaagaggt

SEQ ID NO: 1868 - DNA, 25 bp, Artificial Sequence
  Synthetic oligonucleotide
agauaaggaacaguggaaagaggtt

SEQ ID NO: 1869 - DNA, 25 bp, Artificial Sequence
  Synthetic oligonucleotide
gauaaggaacaguggaaagaggutc

SEQ ID NO: 1870 - DNA, 25 bp, Artificial Sequence
  Synthetic oligonucleotide
auaaggaacaguggaaagagguuca

SEQ ID NO: 1871 - DNA, 25 bp, Artificial Sequence
  Synthetic oligonucleotide
uaaggaacaguggaaagagguucac

SEQ ID NO: 1872 - DNA, 25 bp, Artificial Sequence
  Synthetic oligonucleotide
aaggaacaguggaaagagguucaca

SEQ ID NO: 1873 - DNA, 25 bp, Artificial Sequence
  Synthetic oligonucleotide
aggaacaguggaaagagguucacaa

SEQ ID NO: 1874 - DNA, 25 bp, Artificial Sequence
  Synthetic oligonucleotide
ggaacaguggaaagagguucacaag

SEQ ID NO: 1875 - DNA, 25 bp, Artificial Sequence
  Synthetic oligonucleotide
gaacaguggaaagagguucacaagc

SEQ ID NO: 1876 - DNA, 25 bp, Artificial Sequence
  Synthetic oligonucleotide
aacaguggaaagagguucacaagca

SEQ ID NO: 1877 - DNA, 25 bp, Artificial Sequence
  Synthetic oligonucleotide
acaguggaaagagguucacaagcag

SEQ ID NO: 1878 - DNA, 25 bp, Artificial Sequence
  Synthetic oligonucleotide
caguggaaagagguucacaagcagg

SEQ ID NO: 1879 - DNA, 25 bp, Artificial Sequence
  Synthetic oligonucleotide
aguggaaagagguucacaagcaggt

SEQ ID NO: 1880 - DNA, 25 bp, Artificial Sequence
  Synthetic oligonucleotide
guggaaagagguucacaagcaggtg

SEQ ID NO: 1881 - DNA, 25 bp, Artificial Sequence
  Synthetic oligonucleotide
uggaaagagguucacaagcaggugg

SEQ ID NO: 1882 - DNA, 25 bp, Artificial Sequence
  Synthetic oligonucleotide
ggaaagagguucacaagcagguggt

SEQ ID NO: 1883 - DNA, 25 bp, Artificial Sequence
  Synthetic oligonucleotide
gaaagagguucacaagcagguggtt

SEQ ID NO: 1884 - DNA, 25 bp, Artificial Sequence
  Synthetic oligonucleotide
aaagagguucacaagcagguggutg

SEQ ID NO: 1885 - DNA, 25 bp, Artificial Sequence
  Synthetic oligonucleotide
aagagguucacaagcaggugguuga

SEQ ID NO: 1886 - DNA, 25 bp, Artificial Sequence
  Synthetic oligonucleotide
agagguucacaagcaggugguugag

SEQ ID NO: 1887 - DNA, 25 bp, Artificial Sequence
  Synthetic oligonucleotide
gagguucacaagcaggugguugaga

SEQ ID NO: 1888 - DNA, 25 bp, Artificial Sequence
  Synthetic oligonucleotide
agguucacaagcaggugguugagag

SEQ ID NO: 1889 - DNA, 25 bp, Artificial Sequence
  Synthetic oligonucleotide
gguucacaagcaggugguugagagt

SEQ ID NO: 1890 - DNA, 25 bp, Artificial Sequence
  Synthetic oligonucleotide
guucacaagcaggugguugagagtg

SEQ ID NO: 1891 - DNA, 25 bp, Artificial Sequence
  Synthetic oligonucleotide
uucacaagcaggugguugagagugc

SEQ ID NO: 1892 - DNA, 25 bp, Artificial Sequence
  Synthetic oligonucleotide
ucacaagcaggugguugagagugct

SEQ ID NO: 1893 - DNA, 25 bp, Artificial Sequence
  Synthetic oligonucleotide
cacaagcaggugguugagagugctt

SEQ ID NO: 1894 - DNA, 25 bp, Artificial Sequence
  Synthetic oligonucleotide
acaagcaggugguugagagugcuta

SEQ ID NO: 1895 - DNA, 25 bp, Artificial Sequence
  Synthetic oligonucleotide
caagcaggugguugagagugcuuat

SEQ ID NO: 1896 - DNA, 25 bp, Artificial Sequence
  Synthetic oligonucleotide
aagcaggugguugagagugcuuatg

SEQ ID NO: 1897 - DNA, 25 bp, Artificial Sequence
  Synthetic oligonucleotide
agcaggugguugagagugcuuauga

SEQ ID NO: 1898 - DNA, 25 bp, Artificial Sequence
  Synthetic oligonucleotide
gcaggugguugagagugcuuaugag

SEQ ID NO: 1899 - DNA, 25 bp, Artificial Sequence
  Synthetic oligonucleotide
caggugguugagagugcuuaugagg

SEQ ID NO: 1900 - DNA, 25 bp, Artificial Sequence
  Synthetic oligonucleotide
aggugguugagagugcuuaugaggt

SEQ ID NO: 1901 - DNA, 25 bp, Artificial Sequence
  Synthetic oligonucleotide
ggugguugagagugcuuaugaggtg

SEQ ID NO: 1902 - DNA, 25 bp, Artificial Sequence
  Synthetic oligonucleotide
gugguugagagugcuuaugagguga

SEQ ID NO: 1903 - DNA, 25 bp, Artificial Sequence
  Synthetic oligonucleotide
ugguugagagugcuuaugaggugat

SEQ ID NO: 1904 - DNA, 25 bp, Artificial Sequence
  Synthetic oligonucleotide
gguugagagugcuuaugaggugatc

SEQ ID NO: 1905 - DNA, 25 bp, Artificial Sequence
  Synthetic oligonucleotide
guugagagugcuuaugaggugauca

SEQ ID NO: 1906 - DNA, 25 bp, Artificial Sequence
  Synthetic oligonucleotide
uugagagugcuuaugaggugaucaa

SEQ ID NO: 1907 - DNA, 25 bp, Artificial Sequence
  Synthetic oligonucleotide
ugagagugcuuaugaggugaucaaa

SEQ ID NO: 1908 - DNA, 25 bp, Artificial Sequence
  Synthetic oligonucleotide
gagagugcuuaugaggugaucaaac

SEQ ID NO: 1909 - DNA, 25 bp, Artificial Sequence
  Synthetic oligonucleotide
agagugcuuaugaggugaucaaact

SEQ ID NO: 1910 - DNA, 25 bp, Artificial Sequence
  Synthetic oligonucleotide
gagugcuuaugaggugaucaaactc

SEQ ID NO: 1911 - DNA, 25 bp, Artificial Sequence
  Synthetic oligonucleotide
agugcuuaugaggugaucaaacuca

SEQ ID NO: 1912 - DNA, 25 bp, Artificial Sequence
  Synthetic oligonucleotide
gugcuuaugaggugaucaaacucaa

SEQ ID NO: 1913 - DNA, 25 bp, Artificial Sequence
  Synthetic oligonucleotide
ugcuuaugaggugaucaaacucaaa

SEQ ID NO: 1914 - DNA, 25 bp, Artificial Sequence
  Synthetic oligonucleotide
gcuuaugaggugaucaaacucaaag

SEQ ID NO: 1915 - DNA, 25 bp, Artificial Sequence
  Synthetic oligonucleotide
cuuaugaggugaucaaacucaaagg

SEQ ID NO: 1916 - DNA, 25 bp, Artificial Sequence
  Synthetic oligonucleotide
uuaugaggugaucaaacucaaaggc

SEQ ID NO: 1917 - DNA, 25 bp, Artificial Sequence
  Synthetic oligonucleotide
uaugaggugaucaaacucaaaggct

SEQ ID NO: 1918 - DNA, 25 bp, Artificial Sequence
  Synthetic oligonucleotide
augaggugaucaaacucaaaggcta

SEQ ID NO: 1919 - DNA, 25 bp, Artificial Sequence
  Synthetic oligonucleotide
ugaggugaucaaacucaaaggcuac

SEQ ID NO: 1920 - DNA, 25 bp, Artificial Sequence
  Synthetic oligonucleotide
gaggugaucaaacucaaaggcuaca

SEQ ID NO: 1921 - DNA, 25 bp, Artificial Sequence
  Synthetic oligonucleotide
aggugaucaaacucaaaggcuacac

SEQ ID NO: 1922 - DNA, 25 bp, Artificial Sequence
  Synthetic oligonucleotide
ggugaucaaacucaaaggcuacaca

SEQ ID NO: 1923 - DNA, 25 bp, Artificial Sequence
  Synthetic oligonucleotide
gugaucaaacucaaaggcuacacat

SEQ ID NO: 1924 - DNA, 25 bp, Artificial Sequence
  Synthetic oligonucleotide
ugaucaaacucaaaggcuacacatc

SEQ ID NO: 1925 - DNA, 25 bp, Artificial Sequence
  Synthetic oligonucleotide
gaucaaacucaaaggcuacacaucc

SEQ ID NO: 1926 - DNA, 25 bp, Artificial Sequence
  Synthetic oligonucleotide
aucaaacucaaaggcuacacaucct

SEQ ID NO: 1927 - DNA, 25 bp, Artificial Sequence
  Synthetic oligonucleotide
ucaaacucaaaggcuacacaucctg

SEQ ID NO: 1928 - DNA, 25 bp, Artificial Sequence
  Synthetic oligonucleotide
caaacucaaaggcuacacauccugg

SEQ ID NO: 1929 - DNA, 25 bp, Artificial Sequence
  Synthetic oligonucleotide
aaacucaaaggcuacacauccuggg

SEQ ID NO: 1930 - DNA, 25 bp, Artificial Sequence
  Synthetic oligonucleotide
aacucaaaggcuacacauccugggc

SEQ ID NO: 1931 - DNA, 25 bp, Artificial Sequence
  Synthetic oligonucleotide
acucaaaggcuacacauccugggct

SEQ ID NO: 1932 - DNA, 25 bp, Artificial Sequence
  Synthetic oligonucleotide
cucaaaggcuacacauccugggcta

SEQ ID NO: 1933 - DNA, 25 bp, Artificial Sequence
  Synthetic oligonucleotide
ucaaaggcuacacauccugggcuat

SEQ ID NO: 1934 - DNA, 25 bp, Artificial Sequence
  Synthetic oligonucleotide
caaaggcuacacauccugggcuatt

SEQ ID NO: 1935 - DNA, 25 bp, Artificial Sequence
  Synthetic oligonucleotide
aaaggcuacacauccugggcuautg

SEQ ID NO: 1936 - DNA, 25 bp, Artificial Sequence
  Synthetic oligonucleotide
aaggcuacacauccugggcuauugg

SEQ ID NO: 1937 - DNA, 25 bp, Artificial Sequence
  Synthetic oligonucleotide
aggcuacacauccugggcuauugga

SEQ ID NO: 1938 - DNA, 25 bp, Artificial Sequence
  Synthetic oligonucleotide
ggcuacacauccugggcuauuggac

SEQ ID NO: 1939 - DNA, 25 bp, Artificial Sequence
  Synthetic oligonucleotide
gcuacacauccugggcuauuggact

SEQ ID NO: 1940 - DNA, 25 bp, Artificial Sequence
  Synthetic oligonucleotide
cuacacauccugggcuauuggactc

SEQ ID NO: 1941 - DNA, 25 bp, Artificial Sequence
  Synthetic oligonucleotide
uacacauccugggcuauuggacuct

SEQ ID NO: 1942 - DNA, 25 bp, Artificial Sequence
  Synthetic oligonucleotide
acacauccugggcuauuggacuctc

SEQ ID NO: 1943 - DNA, 25 bp, Artificial Sequence
  Synthetic oligonucleotide
cacauccugggcuauuggacucuct

SEQ ID NO: 1944 - DNA, 25 bp, Artificial Sequence
  Synthetic oligonucleotide
acauccugggcuauuggacucuctg

SEQ ID NO: 1945 - DNA, 25 bp, Artificial Sequence
  Synthetic oligonucleotide
cauccugggcuauuggacucucugt

SEQ ID NO: 1946 - DNA, 25 bp, Artificial Sequence
  Synthetic oligonucleotide
auccugggcuauuggacucucugta

SEQ ID NO: 1947 - DNA, 25 bp, Artificial Sequence
  Synthetic oligonucleotide
uccugggcuauuggacucucuguag

SEQ ID NO: 1948 - DNA, 25 bp, Artificial Sequence
  Synthetic oligonucleotide
ccugggcuauuggacucucuguagc

SEQ ID NO: 1949 - DNA, 25 bp, Artificial Sequence
  Synthetic oligonucleotide
cugggcuauuggacucucuguagca

SEQ ID NO: 1950 - DNA, 25 bp, Artificial Sequence
  Synthetic oligonucleotide
ugggcuauuggacucucuguagcag

SEQ ID NO: 1951 - DNA, 25 bp, Artificial Sequence
  Synthetic oligonucleotide
gggcuauuggacucucuguagcaga

SEQ ID NO: 1952 - DNA, 25 bp, Artificial Sequence
  Synthetic oligonucleotide
ggcuauuggacucucuguagcagat

SEQ ID NO: 1953 - DNA, 25 bp, Artificial Sequence
  Synthetic oligonucleotide
gcuauuggacucucuguagcagatt

SEQ ID NO: 1954 - DNA, 25 bp, Artificial Sequence
  Synthetic oligonucleotide
cuauuggacucucuguagcagautt

SEQ ID NO: 1955 - DNA, 25 bp, Artificial Sequence
  Synthetic oligonucleotide
uauuggacucucuguagcagauutg

SEQ ID NO: 1956 - DNA, 25 bp, Artificial Sequence
  Synthetic oligonucleotide
auuggacucucuguagcagauuugg

SEQ ID NO: 1957 - DNA, 25 bp, Artificial Sequence
  Synthetic oligonucleotide
uuggacucucuguagcagauuuggc

SEQ ID NO: 1958 - DNA, 25 bp, Artificial Sequence
  Synthetic oligonucleotide
uggacucucuguagcagauuuggca

SEQ ID NO: 1959 - DNA, 25 bp, Artificial Sequence
  Synthetic oligonucleotide
ggacucucuguagcagauuuggcag

SEQ ID NO: 1960 - DNA, 25 bp, Artificial Sequence
  Synthetic oligonucleotide
gacucucuguagcagauuuggcaga

SEQ ID NO: 1961 - DNA, 25 bp, Artificial Sequence
  Synthetic oligonucleotide
acucucuguagcagauuuggcagag

SEQ ID NO: 1962 - DNA, 25 bp, Artificial Sequence
  Synthetic oligonucleotide
cucucuguagcagauuuggcagaga

SEQ ID NO: 1963 - DNA, 25 bp, Artificial Sequence
  Synthetic oligonucleotide
ucucuguagcagauuuggcagagag

SEQ ID NO: 1964 - DNA, 25 bp, Artificial Sequence
  Synthetic oligonucleotide
cucuguagcagauuuggcagagagt

SEQ ID NO: 1965 - DNA, 25 bp, Artificial Sequence
  Synthetic oligonucleotide
ucuguagcagauuuggcagagagta

SEQ ID NO: 1966 - DNA, 25 bp, Artificial Sequence
  Synthetic oligonucleotide
cuguagcagauuuggcagagaguat

SEQ ID NO: 1967 - DNA, 25 bp, Artificial Sequence
  Synthetic oligonucleotide
uguagcagauuuggcagagaguata

SEQ ID NO: 1968 - DNA, 25 bp, Artificial Sequence
  Synthetic oligonucleotide
guagcagauuuggcagagaguauaa

SEQ ID NO: 1969 - DNA, 25 bp, Artificial Sequence
  Synthetic oligonucleotide
uagcagauuuggcagagaguauaat

SEQ ID NO: 1970 - DNA, 25 bp, Artificial Sequence
  Synthetic oligonucleotide
agcagauuuggcagagaguauaatg

SEQ ID NO: 1971 - DNA, 25 bp, Artificial Sequence
  Synthetic oligonucleotide
gcagauuuggcagagaguauaauga

SEQ ID NO: 1972 - DNA, 25 bp, Artificial Sequence
  Synthetic oligonucleotide
cagauuuggcagagaguauaaugaa

SEQ ID NO: 1973 - DNA, 25 bp, Artificial Sequence
  Synthetic oligonucleotide
agauuuggcagagaguauaaugaag

SEQ ID NO: 1974 - DNA, 25 bp, Artificial Sequence
  Synthetic oligonucleotide
gauuuggcagagaguauaaugaaga

SEQ ID NO: 1975 - DNA, 25 bp, Artificial Sequence
  Synthetic oligonucleotide
auuuggcagagaguauaaugaagaa

SEQ ID NO: 1976 - DNA, 25 bp, Artificial Sequence
  Synthetic oligonucleotide
uuuggcagagaguauaaugaagaat

SEQ ID NO: 1977 - DNA, 25 bp, Artificial Sequence
  Synthetic oligonucleotide
uuggcagagaguauaaugaagaatc

SEQ ID NO: 1978 - DNA, 25 bp, Artificial Sequence
  Synthetic oligonucleotide
uggcagagaguauaaugaagaauct

SEQ ID NO: 1979 - DNA, 25 bp, Artificial Sequence
  Synthetic oligonucleotide
ggcagagaguauaaugaagaauctt

SEQ ID NO: 1980 - DNA, 25 bp, Artificial Sequence
  Synthetic oligonucleotide
gcagagaguauaaugaagaaucuta

SEQ ID NO: 1981 - DNA, 25 bp, Artificial Sequence
  Synthetic oligonucleotide
cagagaguauaaugaagaaucuuag

SEQ ID NO: 1982 - DNA, 25 bp, Artificial Sequence
  Synthetic oligonucleotide
agagaguauaaugaagaaucuuagg

SEQ ID NO: 1983 - DNA, 25 bp, Artificial Sequence
  Synthetic oligonucleotide
gagaguauaaugaagaaucuuaggc

SEQ ID NO: 1984 - DNA, 25 bp, Artificial Sequence
  Synthetic oligonucleotide
agaguauaaugaagaaucuuaggcg

SEQ ID NO: 1985 - DNA, 25 bp, Artificial Sequence
  Synthetic oligonucleotide
gaguauaaugaagaaucuuaggcgg

SEQ ID NO: 1986 - DNA, 25 bp, Artificial Sequence
  Synthetic oligonucleotide
aguauaaugaagaaucuuaggcggg

SEQ ID NO: 1987 - DNA, 25 bp, Artificial Sequence
  Synthetic oligonucleotide
guauaaugaagaaucuuaggcgggt

SEQ ID NO: 1988 - DNA, 25 bp, Artificial Sequence
  Synthetic oligonucleotide
uauaaugaagaaucuuaggcgggtg

SEQ ID NO: 1989 - DNA, 25 bp, Artificial Sequence
  Synthetic oligonucleotide
auaaugaagaaucuuaggcgggugc

SEQ ID NO: 1990 - DNA, 25 bp, Artificial Sequence
  Synthetic oligonucleotide
uaaugaagaaucuuaggcgggugca

SEQ ID NO: 1991 - DNA, 25 bp, Artificial Sequence
  Synthetic oligonucleotide
aaugaagaaucuuaggcgggugcac

SEQ ID NO: 1992 - DNA, 25 bp, Artificial Sequence
  Synthetic oligonucleotide
augaagaaucuuaggcgggugcacc

SEQ ID NO: 1993 - DNA, 25 bp, Artificial Sequence
  Synthetic oligonucleotide
ugaagaaucuuaggcgggugcaccc

SEQ ID NO: 1994 - DNA, 25 bp, Artificial Sequence
  Synthetic oligonucleotide
gaagaaucuuaggcgggugcaccca

SEQ ID NO: 1995 - DNA, 25 bp, Artificial Sequence
  Synthetic oligonucleotide
aagaaucuuaggcgggugcacccag

SEQ ID NO: 1996 - DNA, 25 bp, Artificial Sequence
  Synthetic oligonucleotide
agaaucuuaggcgggugcacccagt

SEQ ID NO: 1997 - DNA, 25 bp, Artificial Sequence
  Synthetic oligonucleotide
gaaucuuaggcgggugcacccagtt

SEQ ID NO: 1998 - DNA, 25 bp, Artificial Sequence
  Synthetic oligonucleotide
aaucuuaggcgggugcacccagutt

SEQ ID NO: 1999 - DNA, 25 bp, Artificial Sequence
  Synthetic oligonucleotide
aucuuaggcgggugcacccaguutc

SEQ ID NO: 2000 - DNA, 25 bp, Artificial Sequence
  Synthetic oligonucleotide
ucuuaggcgggugcacccaguuucc

SEQ ID NO: 2001 - DNA, 25 bp, Artificial Sequence
  Synthetic oligonucleotide
cuuaggcgggugcacccaguuucca

SEQ ID NO: 2002 - DNA, 25 bp, Artificial Sequence
  Synthetic oligonucleotide
uuaggcgggugcacccaguuuccac

SEQ ID NO: 2003 - DNA, 25 bp, Artificial Sequence
  Synthetic oligonucleotide
uaggcgggugcacccaguuuccacc

SEQ ID NO: 2004 - DNA, 25 bp, Artificial Sequence
  Synthetic oligonucleotide
aggcgggugcacccaguuuccacca

SEQ ID NO: 2005 - DNA, 25 bp, Artificial Sequence
  Synthetic oligonucleotide
ggcgggugcacccaguuuccaccat

SEQ ID NO: 2006 - DNA, 25 bp, Artificial Sequence
  Synthetic oligonucleotide
gcgggugcacccaguuuccaccatg

SEQ ID NO: 2007 - DNA, 25 bp, Artificial Sequence
  Synthetic oligonucleotide
cgggugcacccaguuuccaccauga

SEQ ID NO: 2008 - DNA, 25 bp, Artificial Sequence
  Synthetic oligonucleotide
gggugcacccaguuuccaccaugat

SEQ ID NO: 2009 - DNA, 25 bp, Artificial Sequence
  Synthetic oligonucleotide
ggugcacccaguuuccaccaugatt

SEQ ID NO: 2010 - DNA, 25 bp, Artificial Sequence
  Synthetic oligonucleotide
gugcacccaguuuccaccaugauta

SEQ ID NO: 2011 - DNA, 25 bp, Artificial Sequence
  Synthetic oligonucleotide
ugcacccaguuuccaccaugauuaa

SEQ ID NO: 2012 - DNA, 25 bp, Artificial Sequence
  Synthetic oligonucleotide
gcacccaguuuccaccaugauuaag

SEQ ID NO: 2013 - DNA, 25 bp, Artificial Sequence
  Synthetic oligonucleotide
cacccaguuuccaccaugauuaagg

SEQ ID NO: 2014 - DNA, 25 bp, Artificial Sequence
  Synthetic oligonucleotide
acccaguuuccaccaugauuaaggg

SEQ ID NO: 2015 - DNA, 25 bp, Artificial Sequence
  Synthetic oligonucleotide
cccaguuuccaccaugauuaagggt

SEQ ID NO: 2016 - DNA, 25 bp, Artificial Sequence
  Synthetic oligonucleotide
ccaguuuccaccaugauuaagggtc

SEQ ID NO: 2017 - DNA, 25 bp, Artificial Sequence
  Synthetic oligonucleotide
caguuuccaccaugauuaaggguct

SEQ ID NO: 2018 - DNA, 25 bp, Artificial Sequence
  Synthetic oligonucleotide
aguuuccaccaugauuaaggguctt

SEQ ID NO: 2019 - DNA, 25 bp, Artificial Sequence
  Synthetic oligonucleotide
guuuccaccaugauuaagggucutt

SEQ ID NO: 2020 - DNA, 25 bp, Artificial Sequence
  Synthetic oligonucleotide
uuuccaccaugauuaagggucuuta

SEQ ID NO: 2021 - DNA, 25 bp, Artificial Sequence
  Synthetic oligonucleotide
uuccaccaugauuaagggucuuuac

SEQ ID NO: 2022 - DNA, 25 bp, Artificial Sequence
  Synthetic oligonucleotide
uccaccaugauuaagggucuuuacg

SEQ ID NO: 2023 - DNA, 25 bp, Artificial Sequence
  Synthetic oligonucleotide
ccaccaugauuaagggucuuuacgg

SEQ ID NO: 2024 - DNA, 25 bp, Artificial Sequence
  Synthetic oligonucleotide
caccaugauuaagggucuuuacgga

SEQ ID NO: 2025 - DNA, 25 bp, Artificial Sequence
  Synthetic oligonucleotide
accaugauuaagggucuuuacggaa

SEQ ID NO: 2026 - DNA, 25 bp, Artificial Sequence
  Synthetic oligonucleotide
ccaugauuaagggucuuuacggaat

SEQ ID NO: 2027 - DNA, 25 bp, Artificial Sequence
  Synthetic oligonucleotide
caugauuaagggucuuuacggaata

SEQ ID NO: 2028 - DNA, 25 bp, Artificial Sequence
  Synthetic oligonucleotide
augauuaagggucuuuacggaauaa

SEQ ID NO: 2029 - DNA, 25 bp, Artificial Sequence
  Synthetic oligonucleotide
ugauuaagggucuuuacggaauaaa

SEQ ID NO: 2030 - DNA, 25 bp, Artificial Sequence
  Synthetic oligonucleotide
gauuaagggucuuuacggaauaaag

SEQ ID NO: 2031 - DNA, 25 bp, Artificial Sequence
  Synthetic oligonucleotide
auuaagggucuuuacggaauaaagg

SEQ ID NO: 2032 - DNA, 25 bp, Artificial Sequence
  Synthetic oligonucleotide
uuaagggucuuuacggaauaaagga

SEQ ID NO: 2033 - DNA, 25 bp, Artificial Sequence
  Synthetic oligonucleotide
uaagggucuuuacggaauaaaggat

SEQ ID NO: 2034 - DNA, 25 bp, Artificial Sequence
  Synthetic oligonucleotide
aagggucuuuacggaauaaaggatg

SEQ ID NO: 2035 - DNA, 25 bp, Artificial Sequence
  Synthetic oligonucleotide
agggucuuuacggaauaaaggauga

SEQ ID NO: 2036 - DNA, 25 bp, Artificial Sequence
  Synthetic oligonucleotide
gggucuuuacggaauaaaggaugat

SEQ ID NO: 2037 - DNA, 25 bp, Artificial Sequence
  Synthetic oligonucleotide
ggucuuuacggaauaaaggaugatg

SEQ ID NO: 2038 - DNA, 25 bp, Artificial Sequence
  Synthetic oligonucleotide
gucuuuacggaauaaaggaugaugt

SEQ ID NO: 2039 - DNA, 25 bp, Artificial Sequence
  Synthetic oligonucleotide
ucuuuacggaauaaaggaugaugtc

SEQ ID NO: 2040 - DNA, 25 bp, Artificial Sequence
  Synthetic oligonucleotide
cuuuacggaauaaaggaugauguct

SEQ ID NO: 2041 - DNA, 25 bp, Artificial Sequence
  Synthetic oligonucleotide
uuuacggaauaaaggaugauguctt

SEQ ID NO: 2042 - DNA, 25 bp, Artificial Sequence
  Synthetic oligonucleotide
uuacggaauaaaggaugaugucutc

SEQ ID NO: 2043 - DNA, 25 bp, Artificial Sequence
  Synthetic oligonucleotide
uacggaauaaaggaugaugucuucc

SEQ ID NO: 2044 - DNA, 25 bp, Artificial Sequence
  Synthetic oligonucleotide
acggaauaaaggaugaugucuucct

SEQ ID NO: 2045 - DNA, 25 bp, Artificial Sequence
  Synthetic oligonucleotide
cggaauaaaggaugaugucuucctt

SEQ ID NO: 2046 - DNA, 25 bp, Artificial Sequence
  Synthetic oligonucleotide
ggaauaaaggaugaugucuuccuta

SEQ ID NO: 2047 - DNA, 25 bp, Artificial Sequence
  Synthetic oligonucleotide
gaauaaaggaugaugucuuccuuag

SEQ ID NO: 2048 - DNA, 25 bp, Artificial Sequence
  Synthetic oligonucleotide
aauaaaggaugaugucuuccuuagt

SEQ ID NO: 2049 - DNA, 25 bp, Artificial Sequence
  Synthetic oligonucleotide
auaaaggaugaugucuuccuuagtg

SEQ ID NO: 2050 - DNA, 25 bp, Artificial Sequence
  Synthetic oligonucleotide
uaaaggaugaugucuuccuuagugt

SEQ ID NO: 2051 - DNA, 25 bp, Artificial Sequence
  Synthetic oligonucleotide
aaaggaugaugucuuccuuagugtt

SEQ ID NO: 2052 - DNA, 25 bp, Artificial Sequence
  Synthetic oligonucleotide
aaggaugaugucuuccuuagugutc

SEQ ID NO: 2053 - DNA, 25 bp, Artificial Sequence
  Synthetic oligonucleotide
aggaugaugucuuccuuaguguucc

SEQ ID NO: 2054 - DNA, 25 bp, Artificial Sequence
  Synthetic oligonucleotide
ggaugaugucuuccuuaguguucct

SEQ ID NO: 2055 - DNA, 25 bp, Artificial Sequence
  Synthetic oligonucleotide
gaugaugucuuccuuaguguucctt

SEQ ID NO: 2056 - DNA, 25 bp, Artificial Sequence
  Synthetic oligonucleotide
augaugucuuccuuaguguuccutg

SEQ ID NO: 2057 - DNA, 25 bp, Artificial Sequence
  Synthetic oligonucleotide
ugaugucuuccuuaguguuccuugc

SEQ ID NO: 2058 - DNA, 25 bp, Artificial Sequence
  Synthetic oligonucleotide
gaugucuuccuuaguguuccuugca

SEQ ID NO: 2059 - DNA, 25 bp, Artificial Sequence
  Synthetic oligonucleotide
augucuuccuuaguguuccuugcat

SEQ ID NO: 2060 - DNA, 25 bp, Artificial Sequence
  Synthetic oligonucleotide
ugucuuccuuaguguuccuugcatt

SEQ ID NO: 2061 - DNA, 25 bp, Artificial Sequence
  Synthetic oligonucleotide
gucuuccuuaguguuccuugcautt

SEQ ID NO: 2062 - DNA, 25 bp, Artificial Sequence
  Synthetic oligonucleotide
ucuuccuuaguguuccuugcauutt

SEQ ID NO: 2063 - DNA, 25 bp, Artificial Sequence
  Synthetic oligonucleotide
cuuccuuaguguuccuugcauuutg

SEQ ID NO: 2064 - DNA, 25 bp, Artificial Sequence
  Synthetic oligonucleotide
uuccuuaguguuccuugcauuuugg

SEQ ID NO: 2065 - DNA, 25 bp, Artificial Sequence
  Synthetic oligonucleotide
uccuuaguguuccuugcauuuuggg

SEQ ID NO: 2066 - DNA, 25 bp, Artificial Sequence
  Synthetic oligonucleotide
ccuuaguguuccuugcauuuuggga

SEQ ID NO: 2067 - DNA, 25 bp, Artificial Sequence
  Synthetic oligonucleotide
cuuaguguuccuugcauuuugggac

SEQ ID NO: 2068 - DNA, 25 bp, Artificial Sequence
  Synthetic oligonucleotide
uuaguguuccuugcauuuugggaca

SEQ ID NO: 2069 - DNA, 25 bp, Artificial Sequence
  Synthetic oligonucleotide
uaguguuccuugcauuuugggacag

SEQ ID NO: 2070 - DNA, 25 bp, Artificial Sequence
  Synthetic oligonucleotide
aguguuccuugcauuuugggacaga

SEQ ID NO: 2071 - DNA, 25 bp, Artificial Sequence
  Synthetic oligonucleotide
guguuccuugcauuuugggacagaa

SEQ ID NO: 2072 - DNA, 25 bp, Artificial Sequence
  Synthetic oligonucleotide
uguuccuugcauuuugggacagaat

SEQ ID NO: 2073 - DNA, 25 bp, Artificial Sequence
  Synthetic oligonucleotide
guuccuugcauuuugggacagaatg

SEQ ID NO: 2074 - DNA, 25 bp, Artificial Sequence
  Synthetic oligonucleotide
uuccuugcauuuugggacagaaugg

SEQ ID NO: 2075 - DNA, 25 bp, Artificial Sequence
  Synthetic oligonucleotide
uccuugcauuuugggacagaaugga

SEQ ID NO: 2076 - DNA, 25 bp, Artificial Sequence
  Synthetic oligonucleotide
ccuugcauuuugggacagaauggaa

SEQ ID NO: 2077 - DNA, 25 bp, Artificial Sequence
  Synthetic oligonucleotide
cuugcauuuugggacagaauggaat

SEQ ID NO: 2078 - DNA, 25 bp, Artificial Sequence
  Synthetic oligonucleotide
uugcauuuugggacagaauggaatc

SEQ ID NO: 2079 - DNA, 25 bp, Artificial Sequence
  Synthetic oligonucleotide
ugcauuuugggacagaauggaauct

SEQ ID NO: 2080 - DNA, 25 bp, Artificial Sequence
  Synthetic oligonucleotide
gcauuuugggacagaauggaauctc

SEQ ID NO: 2081 - DNA, 25 bp, Artificial Sequence
  Synthetic oligonucleotide
cauuuugggacagaauggaaucuca

SEQ ID NO: 2082 - DNA, 25 bp, Artificial Sequence
  Synthetic oligonucleotide
auuuugggacagaauggaaucucag

SEQ ID NO: 2083 - DNA, 25 bp, Artificial Sequence
  Synthetic oligonucleotide
uuuugggacagaauggaaucucaga

SEQ ID NO: 2084 - DNA, 25 bp, Artificial Sequence
  Synthetic oligonucleotide
uuugggacagaauggaaucucagac

SEQ ID NO: 2085 - DNA, 25 bp, Artificial Sequence
  Synthetic oligonucleotide
uugggacagaauggaaucucagacc

SEQ ID NO: 2086 - DNA, 25 bp, Artificial Sequence
  Synthetic oligonucleotide
ugggacagaauggaaucucagacct

SEQ ID NO: 2087 - DNA, 25 bp, Artificial Sequence
  Synthetic oligonucleotide
gggacagaauggaaucucagacctt

SEQ ID NO: 2088 - DNA, 25 bp, Artificial Sequence
  Synthetic oligonucleotide
ggacagaauggaaucucagaccutg

SEQ ID NO: 2089 - DNA, 25 bp, Artificial Sequence
  Synthetic oligonucleotide
gacagaauggaaucucagaccuugt

SEQ ID NO: 2090 - DNA, 25 bp, Artificial Sequence
  Synthetic oligonucleotide
acagaauggaaucucagaccuugtg

SEQ ID NO: 2091 - DNA, 25 bp, Artificial Sequence
  Synthetic oligonucleotide
cagaauggaaucucagaccuuguga

SEQ ID NO: 2092 - DNA, 25 bp, Artificial Sequence
  Synthetic oligonucleotide
agaauggaaucucagaccuugugaa

SEQ ID NO: 2093 - DNA, 25 bp, Artificial Sequence
  Synthetic oligonucleotide
gaauggaaucucagaccuugugaag

SEQ ID NO: 2094 - DNA, 25 bp, Artificial Sequence
  Synthetic oligonucleotide
aauggaaucucagaccuugugaagg

SEQ ID NO: 2095 - DNA, 25 bp, Artificial Sequence
  Synthetic oligonucleotide
auggaaucucagaccuugugaaggt

SEQ ID NO: 2096 - DNA, 25 bp, Artificial Sequence
  Synthetic oligonucleotide
uggaaucucagaccuugugaaggtg

SEQ ID NO: 2097 - DNA, 25 bp, Artificial Sequence
  Synthetic oligonucleotide
ggaaucucagaccuugugaagguga

SEQ ID NO: 2098 - DNA, 25 bp, Artificial Sequence
  Synthetic oligonucleotide
gaaucucagaccuugugaaggugac

SEQ ID NO: 2099 - DNA, 25 bp, Artificial Sequence
  Synthetic oligonucleotide
aaucucagaccuugugaaggugact

SEQ ID NO: 2100 - DNA, 25 bp, Artificial Sequence
  Synthetic oligonucleotide
aucucagaccuugugaaggugactc

SEQ ID NO: 2101 - DNA, 25 bp, Artificial Sequence
  Synthetic oligonucleotide
ucucagaccuugugaaggugacuct

SEQ ID NO: 2102 - DNA, 25 bp, Artificial Sequence
  Synthetic oligonucleotide
cucagaccuugugaaggugacuctg

SEQ ID NO: 2103 - DNA, 25 bp, Artificial Sequence
  Synthetic oligonucleotide
ucagaccuugugaaggugacucuga

SEQ ID NO: 2104 - DNA, 25 bp, Artificial Sequence
  Synthetic oligonucleotide
cagaccuugugaaggugacucugac

SEQ ID NO: 2105 - DNA, 25 bp, Artificial Sequence
  Synthetic oligonucleotide
agaccuugugaaggugacucugact

SEQ ID NO: 2106 - DNA, 25 bp, Artificial Sequence
  Synthetic oligonucleotide
gaccuugugaaggugacucugactt

SEQ ID NO: 2107 - DNA, 25 bp, Artificial Sequence
  Synthetic oligonucleotide
accuugugaaggugacucugacutc

SEQ ID NO: 2108 - DNA, 25 bp, Artificial Sequence
  Synthetic oligonucleotide
ccuugugaaggugacucugacuuct

SEQ ID NO: 2109 - DNA, 25 bp, Artificial Sequence
  Synthetic oligonucleotide
cuugugaaggugacucugacuuctg

SEQ ID NO: 2110 - DNA, 25 bp, Artificial Sequence
  Synthetic oligonucleotide
uugugaaggugacucugacuucuga

SEQ ID NO: 2111 - DNA, 25 bp, Artificial Sequence
  Synthetic oligonucleotide
ugugaaggugacucugacuucugag

SEQ ID NO: 2112 - DNA, 25 bp, Artificial Sequence
  Synthetic oligonucleotide
gugaaggugacucugacuucugagg

SEQ ID NO: 2113 - DNA, 25 bp, Artificial Sequence
  Synthetic oligonucleotide
ugaaggugacucugacuucugagga

SEQ ID NO: 2114 - DNA, 25 bp, Artificial Sequence
  Synthetic oligonucleotide
gaaggugacucugacuucugaggaa

SEQ ID NO: 2115 - DNA, 25 bp, Artificial Sequence
  Synthetic oligonucleotide
aaggugacucugacuucugaggaag

SEQ ID NO: 2116 - DNA, 25 bp, Artificial Sequence
  Synthetic oligonucleotide
aggugacucugacuucugaggaaga

SEQ ID NO: 2117 - DNA, 25 bp, Artificial Sequence
  Synthetic oligonucleotide
ggugacucugacuucugaggaagag

SEQ ID NO: 2118 - DNA, 25 bp, Artificial Sequence
  Synthetic oligonucleotide
gugacucugacuucugaggaagagg

SEQ ID NO: 2119 - DNA, 25 bp, Artificial Sequence
  Synthetic oligonucleotide
ugacucugacuucugaggaagaggc

SEQ ID NO: 2120 - DNA, 25 bp, Artificial Sequence
  Synthetic oligonucleotide
gacucugacuucugaggaagaggcc

SEQ ID NO: 2121 - DNA, 25 bp, Artificial Sequence
  Synthetic oligonucleotide
acucugacuucugaggaagaggccc

SEQ ID NO: 2122 - DNA, 25 bp, Artificial Sequence
  Synthetic oligonucleotide
cucugacuucugaggaagaggcccg

SEQ ID NO: 2123 - DNA, 25 bp, Artificial Sequence
  Synthetic oligonucleotide
ucugacuucugaggaagaggcccgt

SEQ ID NO: 2124 - DNA, 25 bp, Artificial Sequence
  Synthetic oligonucleotide
cugacuucugaggaagaggcccgtt

SEQ ID NO: 2125 - DNA, 25 bp, Artificial Sequence
  Synthetic oligonucleotide
ugacuucugaggaagaggcccgutt

SEQ ID NO: 2126 - DNA, 25 bp, Artificial Sequence
  Synthetic oligonucleotide
gacuucugaggaagaggcccguutg

SEQ ID NO: 2127 - DNA, 25 bp, Artificial Sequence
  Synthetic oligonucleotide
acuucugaggaagaggcccguuuga

SEQ ID NO: 2128 - DNA, 25 bp, Artificial Sequence
  Synthetic oligonucleotide
cuucugaggaagaggcccguuugaa

SEQ ID NO: 2129 - DNA, 25 bp, Artificial Sequence
  Synthetic oligonucleotide
uucugaggaagaggcccguuugaag

SEQ ID NO: 2130 - DNA, 25 bp, Artificial Sequence
  Synthetic oligonucleotide
ucugaggaagaggcccguuugaaga

SEQ ID NO: 2131 - DNA, 25 bp, Artificial Sequence
  Synthetic oligonucleotide
cugaggaagaggcccguuugaagaa

SEQ ID NO: 2132 - DNA, 25 bp, Artificial Sequence
  Synthetic oligonucleotide
ugaggaagaggcccguuugaagaag

SEQ ID NO: 2133 - DNA, 25 bp, Artificial Sequence
  Synthetic oligonucleotide
gaggaagaggcccguuugaagaaga

SEQ ID NO: 2134 - DNA, 25 bp, Artificial Sequence
  Synthetic oligonucleotide
aggaagaggcccguuugaagaagag

SEQ ID NO: 2135 - DNA, 25 bp, Artificial Sequence
  Synthetic oligonucleotide
ggaagaggcccguuugaagaagagt

SEQ ID NO: 2136 - DNA, 25 bp, Artificial Sequence
  Synthetic oligonucleotide
gaagaggcccguuugaagaagagtg

SEQ ID NO: 2137 - DNA, 25 bp, Artificial Sequence
  Synthetic oligonucleotide
aagaggcccguuugaagaagagugc

SEQ ID NO: 2138 - DNA, 25 bp, Artificial Sequence
  Synthetic oligonucleotide
agaggcccguuugaagaagagugca

SEQ ID NO: 2139 - DNA, 25 bp, Artificial Sequence
  Synthetic oligonucleotide
gaggcccguuugaagaagagugcag

SEQ ID NO: 2140 - DNA, 25 bp, Artificial Sequence
  Synthetic oligonucleotide
aggcccguuugaagaagagugcaga

SEQ ID NO: 2141 - DNA, 25 bp, Artificial Sequence
  Synthetic oligonucleotide
ggcccguuugaagaagagugcagat

SEQ ID NO: 2142 - DNA, 25 bp, Artificial Sequence
  Synthetic oligonucleotide
gcccguuugaagaagagugcagata

SEQ ID NO: 2143 - DNA, 25 bp, Artificial Sequence
  Synthetic oligonucleotide
cccguuugaagaagagugcagauac

SEQ ID NO: 2144 - DNA, 25 bp, Artificial Sequence
  Synthetic oligonucleotide
ccguuugaagaagagugcagauaca

SEQ ID NO: 2145 - DNA, 25 bp, Artificial Sequence
  Synthetic oligonucleotide
cguuugaagaagagugcagauacac

SEQ ID NO: 2146 - DNA, 25 bp, Artificial Sequence
  Synthetic oligonucleotide
guuugaagaagagugcagauacact

SEQ ID NO: 2147 - DNA, 25 bp, Artificial Sequence
  Synthetic oligonucleotide
uuugaagaagagugcagauacactt

SEQ ID NO: 2148 - DNA, 25 bp, Artificial Sequence
  Synthetic oligonucleotide
uugaagaagagugcagauacacutt

SEQ ID NO: 2149 - DNA, 25 bp, Artificial Sequence
  Synthetic oligonucleotide
ugaagaagagugcagauacacuutg

SEQ ID NO: 2150 - DNA, 25 bp, Artificial Sequence
  Synthetic oligonucleotide
gaagaagagugcagauacacuuugg

SEQ ID NO: 2151 - DNA, 25 bp, Artificial Sequence
  Synthetic oligonucleotide
aagaagagugcagauacacuuuggg

SEQ ID NO: 2152 - DNA, 25 bp, Artificial Sequence
  Synthetic oligonucleotide
agaagagugcagauacacuuugggg

SEQ ID NO: 2153 - DNA, 25 bp, Artificial Sequence
  Synthetic oligonucleotide
gaagagugcagauacacuuuggggg

SEQ ID NO: 2154 - DNA, 25 bp, Artificial Sequence
  Synthetic oligonucleotide
aagagugcagauacacuuuggggga

SEQ ID NO: 2155 - DNA, 25 bp, Artificial Sequence
  Synthetic oligonucleotide
agagugcagauacacuuugggggat

SEQ ID NO: 2156 - DNA, 25 bp, Artificial Sequence
  Synthetic oligonucleotide
gagugcagauacacuuugggggatc

SEQ ID NO: 2157 - DNA, 25 bp, Artificial Sequence
  Synthetic oligonucleotide
agugcagauacacuuugggggaucc

SEQ ID NO: 2158 - DNA, 25 bp, Artificial Sequence
  Synthetic oligonucleotide
gugcagauacacuuugggggaucca

SEQ ID NO: 2159 - DNA, 25 bp, Artificial Sequence
  Synthetic oligonucleotide
ugcagauacacuuugggggauccaa

SEQ ID NO: 2160 - DNA, 25 bp, Artificial Sequence
  Synthetic oligonucleotide
gcagauacacuuugggggauccaaa

SEQ ID NO: 2161 - DNA, 25 bp, Artificial Sequence
  Synthetic oligonucleotide
cagauacacuuugggggauccaaaa

SEQ ID NO: 2162 - DNA, 25 bp, Artificial Sequence
  Synthetic oligonucleotide
agauacacuuugggggauccaaaag

SEQ ID NO: 2163 - DNA, 25 bp, Artificial Sequence
  Synthetic oligonucleotide
gauacacuuugggggauccaaaagg

SEQ ID NO: 2164 - DNA, 25 bp, Artificial Sequence
  Synthetic oligonucleotide
auacacuuugggggauccaaaagga

SEQ ID NO: 2165 - DNA, 25 bp, Artificial Sequence
  Synthetic oligonucleotide
uacacuuugggggauccaaaaggag

SEQ ID NO: 2166 - DNA, 25 bp, Artificial Sequence
  Synthetic oligonucleotide
acacuuugggggauccaaaaggagc

SEQ ID NO: 2167 - DNA, 25 bp, Artificial Sequence
  Synthetic oligonucleotide
cacuuugggggauccaaaaggagct

SEQ ID NO: 2168 - DNA, 25 bp, Artificial Sequence
  Synthetic oligonucleotide
acuuugggggauccaaaaggagctg

SEQ ID NO: 2169 - DNA, 25 bp, Artificial Sequence
  Synthetic oligonucleotide
cuuugggggauccaaaaggagcugc

SEQ ID NO: 2170 - DNA, 25 bp, Artificial Sequence
  Synthetic oligonucleotide
uuugggggauccaaaaggagcugca

SEQ ID NO: 2171 - DNA, 25 bp, Artificial Sequence
  Synthetic oligonucleotide
uugggggauccaaaaggagcugcaa

SEQ ID NO: 2172 - DNA, 25 bp, Artificial Sequence
  Synthetic oligonucleotide
ugggggauccaaaaggagcugcaat

SEQ ID NO: 2173 - DNA, 25 bp, Artificial Sequence
  Synthetic oligonucleotide
gggggauccaaaaggagcugcaatt

SEQ ID NO: 2174 - DNA, 25 bp, Artificial Sequence
  Synthetic oligonucleotide
ggggauccaaaaggagcugcaautt

SEQ ID NO: 2175 - DNA, 25 bp, Artificial Sequence
  Synthetic oligonucleotide
gggauccaaaaggagcugcaauutt

SEQ ID NO: 2176 - DNA, 25 bp, Artificial Sequence
  Synthetic oligonucleotide
ggauccaaaaggagcugcaauuuta

SEQ ID NO: 2177 - DNA, 25 bp, Artificial Sequence
  Synthetic oligonucleotide
gauccaaaaggagcugcaauuuuaa

SEQ ID NO: 2178 - DNA, 25 bp, Artificial Sequence
  Synthetic oligonucleotide
auccaaaaggagcugcaauuuuaaa

SEQ ID NO: 2179 - DNA, 25 bp, Artificial Sequence
  Synthetic oligonucleotide
uccaaaaggagcugcaauuuuaaag

SEQ ID NO: 2180 - DNA, 25 bp, Artificial Sequence
  Synthetic oligonucleotide
ccaaaaggagcugcaauuuuaaagt

SEQ ID NO: 2181 - DNA, 25 bp, Artificial Sequence
  Synthetic oligonucleotide
caaaaggagcugcaauuuuaaagtc

SEQ ID NO: 2182 - DNA, 25 bp, Artificial Sequence
  Synthetic oligonucleotide
aaaaggagcugcaauuuuaaaguct

SEQ ID NO: 2183 - DNA, 25 bp, Artificial Sequence
  Synthetic oligonucleotide
aaaggagcugcaauuuuaaaguctt

SEQ ID NO: 2184 - DNA, 25 bp, Artificial Sequence
  Synthetic oligonucleotide
aaggagcugcaauuuuaaagucutc

SEQ ID NO: 2185 - DNA, 25 bp, Artificial Sequence
  Synthetic oligonucleotide
aggagcugcaauuuuaaagucuuct

SEQ ID NO: 2186 - DNA, 25 bp, Artificial Sequence
  Synthetic oligonucleotide
ggagcugcaauuuuaaagucuuctg

SEQ ID NO: 2187 - DNA, 25 bp, Artificial Sequence
  Synthetic oligonucleotide
gagcugcaauuuuaaagucuucuga

SEQ ID NO: 2188 - DNA, 25 bp, Artificial Sequence
  Synthetic oligonucleotide
agcugcaauuuuaaagucuucugat

SEQ ID NO: 2189 - DNA, 25 bp, Artificial Sequence
  Synthetic oligonucleotide
gcugcaauuuuaaagucuucugatg

SEQ ID NO: 2190 - DNA, 25 bp, Artificial Sequence
  Synthetic oligonucleotide
cugcaauuuuaaagucuucugaugt

SEQ ID NO: 2191 - DNA, 25 bp, Artificial Sequence
  Synthetic oligonucleotide
ugcaauuuuaaagucuucugaugtc

SEQ ID NO: 2192 - DNA, 25 bp, Artificial Sequence
  Synthetic oligonucleotide
aauuuuaaagucuucugaugucata

SEQ ID NO: 2193 - DNA, 25 bp, Artificial Sequence
  Synthetic oligonucleotide
auuuuaaagucuucugaugucauat

SEQ ID NO: 2194 - DNA, 25 bp, Artificial Sequence
  Synthetic oligonucleotide
uuuuaaagucuucugaugucauatc

SEQ ID NO: 2195 - DNA, 25 bp, Artificial Sequence
  Synthetic oligonucleotide
uuuaaagucuucugaugucauauca

SEQ ID NO: 2196 - DNA, 25 bp, Artificial Sequence
  Synthetic oligonucleotide
aagucuucugaugucauaucauutc

SEQ ID NO: 2197 - DNA, 25 bp, Artificial Sequence
  Synthetic oligonucleotide
agucuucugaugucauaucauuuca

SEQ ID NO: 2198 - DNA, 25 bp, Artificial Sequence
  Synthetic oligonucleotide
gucuucugaugucauaucauuucac

SEQ ID NO: 2199 - DNA, 25 bp, Artificial Sequence
  Synthetic oligonucleotide
ucuucugaugucauaucauuucact

SEQ ID NO: 2200 - DNA, 25 bp, Artificial Sequence
  Synthetic oligonucleotide
cuucugaugucauaucauuucactg

SEQ ID NO: 2201 - DNA, 25 bp, Artificial Sequence
  Synthetic oligonucleotide
uucugaugucauaucauuucacugt

SEQ ID NO: 2202 - DNA, 25 bp, Artificial Sequence
  Synthetic oligonucleotide
ucugaugucauaucauuucacugtc

SEQ ID NO: 2203 - DNA, 25 bp, Artificial Sequence
  Synthetic oligonucleotide
cugaugucauaucauuucacuguct

SEQ ID NO: 2204 - DNA, 25 bp, Artificial Sequence
  Synthetic oligonucleotide
ugaugucauaucauuucacugucta

SEQ ID NO: 2205 - DNA, 25 bp, Artificial Sequence
  Synthetic oligonucleotide
gaugucauaucauuucacugucuag

SEQ ID NO: 2206 - DNA, 25 bp, Artificial Sequence
  Synthetic oligonucleotide
augucauaucauuucacugucuagg

SEQ ID NO: 2207 - DNA, 25 bp, Artificial Sequence
  Synthetic oligonucleotide
ugucauaucauuucacugucuaggc

SEQ ID NO: 2208 - DNA, 25 bp, Artificial Sequence
  Synthetic oligonucleotide
gucauaucauuucacugucuaggct

SEQ ID NO: 2209 - DNA, 25 bp, Artificial Sequence
  Synthetic oligonucleotide
ucauaucauuucacugucuaggcta

SEQ ID NO: 2210 - DNA, 25 bp, Artificial Sequence
  Synthetic oligonucleotide
cauaucauuucacugucuaggcuac

SEQ ID NO: 2211 - DNA, 25 bp, Artificial Sequence
  Synthetic oligonucleotide
auaucauuucacugucuaggcuaca

SEQ ID NO: 2212 - DNA, 25 bp, Artificial Sequence
  Synthetic oligonucleotide
uaucauuucacugucuaggcuacaa

SEQ ID NO: 2213 - DNA, 25 bp, Artificial Sequence
  Synthetic oligonucleotide
aucauuucacugucuaggcuacaac

SEQ ID NO: 2214 - DNA, 25 bp, Artificial Sequence
  Synthetic oligonucleotide
ucauuucacugucuaggcuacaaca

SEQ ID NO: 2215 - DNA, 25 bp, Artificial Sequence
  Synthetic oligonucleotide
cauuucacugucuaggcuacaacag

SEQ ID NO: 2216 - DNA, 25 bp, Artificial Sequence
  Synthetic oligonucleotide
auuucacugucuaggcuacaacagg

SEQ ID NO: 2217 - DNA, 25 bp, Artificial Sequence
  Synthetic oligonucleotide
uuucacugucuaggcuacaacagga

SEQ ID NO: 2218 - DNA, 25 bp, Artificial Sequence
  Synthetic oligonucleotide
uucacugucuaggcuacaacaggat

SEQ ID NO: 2219 - DNA, 25 bp, Artificial Sequence
  Synthetic oligonucleotide
ucacugucuaggcuacaacaggatt

SEQ ID NO: 2220 - DNA, 25 bp, Artificial Sequence
  Synthetic oligonucleotide
cacugucuaggcuacaacaggautc

SEQ ID NO: 2221 - DNA, 25 bp, Artificial Sequence
  Synthetic oligonucleotide
acugucuaggcuacaacaggauuct

SEQ ID NO: 2222 - DNA, 25 bp, Artificial Sequence
  Synthetic oligonucleotide
cugucuaggcuacaacaggauucta

SEQ ID NO: 2223 - DNA, 25 bp, Artificial Sequence
  Synthetic oligonucleotide
ugucuaggcuacaacaggauucuag

SEQ ID NO: 2224 - DNA, 25 bp, Artificial Sequence
  Synthetic oligonucleotide
gucuaggcuacaacaggauucuagg

SEQ ID NO: 2225 - DNA, 25 bp, Artificial Sequence
  Synthetic oligonucleotide
ucuaggcuacaacaggauucuaggt

SEQ ID NO: 2226 - DNA, 25 bp, Artificial Sequence
  Synthetic oligonucleotide
cuaggcuacaacaggauucuaggtg

SEQ ID NO: 2227 - DNA, 25 bp, Artificial Sequence
  Synthetic oligonucleotide
uaggcuacaacaggauucuaggugg

SEQ ID NO: 2228 - DNA, 25 bp, Artificial Sequence
  Synthetic oligonucleotide
aggcuacaacaggauucuaggugga

SEQ ID NO: 2229 - DNA, 25 bp, Artificial Sequence
  Synthetic oligonucleotide
ggcuacaacaggauucuagguggag

SEQ ID NO: 2230 - DNA, 25 bp, Artificial Sequence
  Synthetic oligonucleotide
gcuacaacaggauucuagguggagg

SEQ ID NO: 2231 - DNA, 25 bp, Artificial Sequence
  Synthetic oligonucleotide
cuacaacaggauucuagguggaggt

SEQ ID NO: 2232 - DNA, 25 bp, Artificial Sequence
  Synthetic oligonucleotide
uacaacaggauucuagguggaggtt

SEQ ID NO: 2233 - DNA, 25 bp, Artificial Sequence
  Synthetic oligonucleotide
acaacaggauucuagguggaggutg

SEQ ID NO: 2234 - DNA, 25 bp, Artificial Sequence
  Synthetic oligonucleotide
caacaggauucuagguggagguugt

SEQ ID NO: 2235 - DNA, 25 bp, Artificial Sequence
  Synthetic oligonucleotide
aacaggauucuagguggagguugtg

SEQ ID NO: 2236 - DNA, 25 bp, Artificial Sequence
  Synthetic oligonucleotide
acaggauucuagguggagguugugc

SEQ ID NO: 2237 - DNA, 25 bp, Artificial Sequence
  Synthetic oligonucleotide
caggauucuagguggagguugugca

SEQ ID NO: 2238 - DNA, 25 bp, Artificial Sequence
  Synthetic oligonucleotide
aggauucuagguggagguugugcat

SEQ ID NO: 2239 - DNA, 25 bp, Artificial Sequence
  Synthetic oligonucleotide
ggauucuagguggagguugugcatg

SEQ ID NO: 2240 - DNA, 25 bp, Artificial Sequence
  Synthetic oligonucleotide
gauucuagguggagguugugcaugt

SEQ ID NO: 2241 - DNA, 25 bp, Artificial Sequence
  Synthetic oligonucleotide
auucuagguggagguugugcaugtt

SEQ ID NO: 2242 - DNA, 25 bp, Artificial Sequence
  Synthetic oligonucleotide
uucuagguggagguugugcaugutg

SEQ ID NO: 2243 - DNA, 25 bp, Artificial Sequence
  Synthetic oligonucleotide
ucuagguggagguugugcauguugt

SEQ ID NO: 2244 - DNA, 25 bp, Artificial Sequence
  Synthetic oligonucleotide
cuagguggagguugugcauguugtc

SEQ ID NO: 2245 - DNA, 25 bp, Artificial Sequence
  Synthetic oligonucleotide
uagguggagguugugcauguugucc

SEQ ID NO: 2246 - DNA, 25 bp, Artificial Sequence
  Synthetic oligonucleotide
agguggagguugugcauguugucct

SEQ ID NO: 2247 - DNA, 25 bp, Artificial Sequence
  Synthetic oligonucleotide
gguggagguugugcauguugucctt

SEQ ID NO: 2248 - DNA, 25 bp, Artificial Sequence
  Synthetic oligonucleotide
guggagguugugcauguuguccutt

SEQ ID NO: 2249 - DNA, 25 bp, Artificial Sequence
  Synthetic oligonucleotide
uggagguugugcauguuguccuutt

SEQ ID NO: 2250 - DNA, 25 bp, Artificial Sequence
  Synthetic oligonucleotide
ggagguugugcauguuguccuuutt

SEQ ID NO: 2251 - DNA, 25 bp, Artificial Sequence
  Synthetic oligonucleotide
gagguugugcauguuguccuuuuta

SEQ ID NO: 2252 - DNA, 25 bp, Artificial Sequence
  Synthetic oligonucleotide
agguugugcauguuguccuuuuuat

SEQ ID NO: 2253 - DNA, 25 bp, Artificial Sequence
  Synthetic oligonucleotide
gguugugcauguuguccuuuuuatc

SEQ ID NO: 2254 - DNA, 25 bp, Artificial Sequence
  Synthetic oligonucleotide
guugugcauguuguccuuuuuauct

SEQ ID NO: 2255 - DNA, 25 bp, Artificial Sequence
  Synthetic oligonucleotide
uugugcauguuguccuuuuuauctg

SEQ ID NO: 2256 - DNA, 25 bp, Artificial Sequence
  Synthetic oligonucleotide
ugugcauguuguccuuuuuaucuga

SEQ ID NO: 2257 - DNA, 25 bp, Artificial Sequence
  Synthetic oligonucleotide
gugcauguuguccuuuuuaucugat

SEQ ID NO: 2258 - DNA, 25 bp, Artificial Sequence
  Synthetic oligonucleotide
ugcauguuguccuuuuuaucugatc

SEQ ID NO: 2259 - DNA, 25 bp, Artificial Sequence
  Synthetic oligonucleotide
gcauguuguccuuuuuaucugauct

SEQ ID NO: 2260 - DNA, 25 bp, Artificial Sequence
  Synthetic oligonucleotide
uguccuuuuuaucugaucugugatt

SEQ ID NO: 2261 - DNA, 25 bp, Artificial Sequence
  Synthetic oligonucleotide
uuuuuaucugaucugugauuaaagc

SEQ ID NO: 2262 - DNA, 25 bp, Artificial Sequence
  Synthetic oligonucleotide
uaucugaucugugauuaaagcagta

SEQ ID NO: 2263 - DNA, 25 bp, Artificial Sequence
  Synthetic oligonucleotide
aucugaucugugauuaaagcaguaa

SEQ ID NO: 2264 - DNA, 25 bp, Artificial Sequence
  Synthetic oligonucleotide
ucugaucugugauuaaagcaguaat

SEQ ID NO: 2265 - DNA, 25 bp, Artificial Sequence
  Synthetic oligonucleotide
cugaucugugauuaaagcaguaata

SEQ ID NO: 2266 - DNA, 25 bp, Artificial Sequence
  Synthetic oligonucleotide
ugaucugugauuaaagcaguaauat

SEQ ID NO: 2267 - DNA, 25 bp, Artificial Sequence
  Synthetic oligonucleotide
gaucugugauuaaagcaguaauatt

SEQ ID NO: 2268 - DNA, 25 bp, Artificial Sequence
  Synthetic oligonucleotide
aucugugauuaaagcaguaauautt

SEQ ID NO: 2269 - DNA, 25 bp, Artificial Sequence
  Synthetic oligonucleotide
ucugugauuaaagcaguaauauutt

SEQ ID NO: 2270 - DNA, 25 bp, Artificial Sequence
  Synthetic oligonucleotide
cugugauuaaagcaguaauauuuta

SEQ ID NO: 2271 - DNA, 25 bp, Artificial Sequence
  Synthetic oligonucleotide
ugugauuaaagcaguaauauuuuaa

SEQ ID NO: 2272 - DNA, 25 bp, Artificial Sequence
  Synthetic oligonucleotide
gugauuaaagcaguaauauuuuaag

SEQ ID NO: 2273 - DNA, 25 bp, Artificial Sequence
  Synthetic oligonucleotide
ugauuaaagcaguaauauuuuaaga

SEQ ID NO: 2274 - DNA, 25 bp, Artificial Sequence
  Synthetic oligonucleotide
gauuaaagcaguaauauuuuaagat

SEQ ID NO: 2275 - DNA, 25 bp, Artificial Sequence
  Synthetic oligonucleotide
auuaaagcaguaauauuuuaagatg

SEQ ID NO: 2276 - DNA, 25 bp, Artificial Sequence
  Synthetic oligonucleotide
uuaaagcaguaauauuuuaagaugg

SEQ ID NO: 2277 - DNA, 25 bp, Artificial Sequence
  Synthetic oligonucleotide
uaaagcaguaauauuuuaagaugga

SEQ ID NO: 2278 - DNA, 25 bp, Artificial Sequence
  Synthetic oligonucleotide
aaagcaguaauauuuuaagauggac

SEQ ID NO: 2279 - DNA, 25 bp, Artificial Sequence
  Synthetic oligonucleotide
aagcaguaauauuuuaagauggact

SEQ ID NO: 2280 - DNA, 25 bp, Artificial Sequence
  Synthetic oligonucleotide
agcaguaauauuuuaagauggactg

SEQ ID NO: 2281 - DNA, 25 bp, Artificial Sequence
  Synthetic oligonucleotide
gcaguaauauuuuaagauggacugg

SEQ ID NO: 2282 - DNA, 25 bp, Artificial Sequence
  Synthetic oligonucleotide
aguaauauuuuaagauggacuggga

SEQ ID NO: 2283 - DNA, 25 bp, Artificial Sequence
  Synthetic oligonucleotide
guaauauuuuaagauggacugggaa

SEQ ID NO: 2284 - DNA, 25 bp, Artificial Sequence
  Synthetic oligonucleotide
uaauauuuuaagauggacugggaaa

SEQ ID NO: 2285 - DNA, 25 bp, Artificial Sequence
  Synthetic oligonucleotide
aauauuuuaagauggacugggaaaa

SEQ ID NO: 2286 - DNA, 25 bp, Artificial Sequence
  Synthetic oligonucleotide
auauuuuaagauggacugggaaaaa

SEQ ID NO: 2287 - DNA, 25 bp, Artificial Sequence
  Synthetic oligonucleotide
uauuuuaagauggacugggaaaaac

SEQ ID NO: 2288 - DNA, 25 bp, Artificial Sequence
  Synthetic oligonucleotide
auuuuaagauggacugggaaaaaca

SEQ ID NO: 2289 - DNA, 25 bp, Artificial Sequence
  Synthetic oligonucleotide
uuuuaagauggacugggaaaaacat

SEQ ID NO: 2290 - DNA, 25 bp, Artificial Sequence
  Synthetic oligonucleotide
uuuaagauggacugggaaaaacatc

SEQ ID NO: 2291 - DNA, 25 bp, Artificial Sequence
  Synthetic oligonucleotide
uuaagauggacugggaaaaacauca

SEQ ID NO: 2292 - DNA, 25 bp, Artificial Sequence
  Synthetic oligonucleotide
uaagauggacugggaaaaacaucaa

SEQ ID NO: 2293 - DNA, 25 bp, Artificial Sequence
  Synthetic oligonucleotide
aagauggacugggaaaaacaucaac

SEQ ID NO: 2294 - DNA, 25 bp, Artificial Sequence
  Synthetic oligonucleotide
agauggacugggaaaaacaucaact

SEQ ID NO: 2295 - DNA, 25 bp, Artificial Sequence
  Synthetic oligonucleotide
gauggacugggaaaaacaucaactc

SEQ ID NO: 2296 - DNA, 25 bp, Artificial Sequence
  Synthetic oligonucleotide
auggacugggaaaaacaucaacucc

SEQ ID NO: 2297 - DNA, 25 bp, Artificial Sequence
  Synthetic oligonucleotide
uggacugggaaaaacaucaacucct

SEQ ID NO: 2298 - DNA, 25 bp, Artificial Sequence
  Synthetic oligonucleotide
ggacugggaaaaacaucaacucctg

SEQ ID NO: 2299 - DNA, 25 bp, Artificial Sequence
  Synthetic oligonucleotide
gacugggaaaaacaucaacuccuga

SEQ ID NO: 2300 - DNA, 25 bp, Artificial Sequence
  Synthetic oligonucleotide
acugggaaaaacaucaacuccugaa

SEQ ID NO: 2301 - DNA, 25 bp, Artificial Sequence
  Synthetic oligonucleotide
cugggaaaaacaucaacuccugaag

SEQ ID NO: 2302 - DNA, 25 bp, Artificial Sequence
  Synthetic oligonucleotide
ugggaaaaacaucaacuccugaagt

SEQ ID NO: 2303 - DNA, 25 bp, Artificial Sequence
  Synthetic oligonucleotide
gggaaaaacaucaacuccugaagtt

SEQ ID NO: 2304 - DNA, 25 bp, Artificial Sequence
  Synthetic oligonucleotide
ggaaaaacaucaacuccugaaguta

SEQ ID NO: 2305 - DNA, 25 bp, Artificial Sequence
  Synthetic oligonucleotide
gaaaaacaucaacuccugaaguuag

SEQ ID NO: 2306 - DNA, 25 bp, Artificial Sequence
  Synthetic oligonucleotide
aaaaacaucaacuccugaaguuaga

SEQ ID NO: 2307 - DNA, 25 bp, Artificial Sequence
  Synthetic oligonucleotide
aaaacaucaacuccugaaguuagaa

SEQ ID NO: 2308 - DNA, 25 bp, Artificial Sequence
  Synthetic oligonucleotide
aaacaucaacuccugaaguuagaaa

SEQ ID NO: 2309 - DNA, 25 bp, Artificial Sequence
  Synthetic oligonucleotide
aacaucaacuccugaaguuagaaat

SEQ ID NO: 2310 - DNA, 25 bp, Artificial Sequence
  Synthetic oligonucleotide
acaucaacuccugaaguuagaaata

SEQ ID NO: 2311 - DNA, 25 bp, Artificial Sequence
  Synthetic oligonucleotide
caucaacuccugaaguuagaaauaa

SEQ ID NO: 2312 - DNA, 25 bp, Artificial Sequence
  Synthetic oligonucleotide
aucaacuccugaaguuagaaauaag

SEQ ID NO: 2313 - DNA, 25 bp, Artificial Sequence
  Synthetic oligonucleotide
ucaacuccugaaguuagaaauaaga

SEQ ID NO: 2314 - DNA, 25 bp, Artificial Sequence
  Synthetic oligonucleotide
caacuccugaaguuagaaauaagaa

SEQ ID NO: 2315 - DNA, 25 bp, Artificial Sequence
  Synthetic oligonucleotide
cuccugaaguuagaaauaagaaugg

SEQ ID NO: 2316 - DNA, 25 bp, Artificial Sequence
  Synthetic oligonucleotide
uccugaaguuagaaauaagaauggt

SEQ ID NO: 2317 - DNA, 25 bp, Artificial Sequence
  Synthetic oligonucleotide
ccugaaguuagaaauaagaauggtt

SEQ ID NO: 2318 - DNA, 25 bp, Artificial Sequence
  Synthetic oligonucleotide
cugaaguuagaaauaagaauggutt

SEQ ID NO: 2319 - DNA, 25 bp, Artificial Sequence
  Synthetic oligonucleotide
ugaaguuagaaauaagaaugguutg

SEQ ID NO: 2320 - DNA, 25 bp, Artificial Sequence
  Synthetic oligonucleotide
gaaguuagaaauaagaaugguuugt

SEQ ID NO: 2321 - DNA, 25 bp, Artificial Sequence
  Synthetic oligonucleotide
aaguuagaaauaagaaugguuugta

SEQ ID NO: 2322 - DNA, 25 bp, Artificial Sequence
  Synthetic oligonucleotide
aguuagaaauaagaaugguuuguaa

SEQ ID NO: 2323 - DNA, 25 bp, Artificial Sequence
  Synthetic oligonucleotide
guuagaaauaagaaugguuuguaaa

SEQ ID NO: 2324 - DNA, 25 bp, Artificial Sequence
  Synthetic oligonucleotide
uuagaaauaagaaugguuuguaaaa

SEQ ID NO: 2325 - DNA, 25 bp, Artificial Sequence
  Synthetic oligonucleotide
uagaaauaagaaugguuuguaaaat

SEQ ID NO: 2326 - DNA, 25 bp, Artificial Sequence
  Synthetic oligonucleotide
agaaauaagaaugguuuguaaaatc

SEQ ID NO: 2327 - DNA, 25 bp, Artificial Sequence
  Synthetic oligonucleotide
gaaauaagaaugguuuguaaaaucc

SEQ ID NO: 2328 - DNA, 25 bp, Artificial Sequence
  Synthetic oligonucleotide
aaauaagaaugguuuguaaaaucca

SEQ ID NO: 2329 - DNA, 25 bp, Artificial Sequence
  Synthetic oligonucleotide
aauaagaaugguuuguaaaauccac

SEQ ID NO: 2330 - DNA, 25 bp, Artificial Sequence
  Synthetic oligonucleotide
auaagaaugguuuguaaaauccaca

SEQ ID NO: 2331 - DNA, 25 bp, Artificial Sequence
  Synthetic oligonucleotide
uaagaaugguuuguaaaauccacag

SEQ ID NO: 2332 - DNA, 25 bp, Artificial Sequence
  Synthetic oligonucleotide
aagaaugguuuguaaaauccacagc

SEQ ID NO: 2333 - DNA, 25 bp, Artificial Sequence
  Synthetic oligonucleotide
agaaugguuuguaaaauccacagct

SEQ ID NO: 2334 - DNA, 25 bp, Artificial Sequence
  Synthetic oligonucleotide
gaaugguuuguaaaauccacagcta

SEQ ID NO: 2335 - DNA, 25 bp, Artificial Sequence
  Synthetic oligonucleotide
aaugguuuguaaaauccacagcuat

SEQ ID NO: 2336 - DNA, 25 bp, Artificial Sequence
  Synthetic oligonucleotide
augguuuguaaaauccacagcuata

SEQ ID NO: 2337 - DNA, 25 bp, Artificial Sequence
  Synthetic oligonucleotide
ugguuuguaaaauccacagcuauat

SEQ ID NO: 2338 - DNA, 25 bp, Artificial Sequence
  Synthetic oligonucleotide
gguuuguaaaauccacagcuauatc

SEQ ID NO: 2339 - DNA, 25 bp, Artificial Sequence
  Synthetic oligonucleotide
guuuguaaaauccacagcuauaucc

SEQ ID NO: 2340 - DNA, 25 bp, Artificial Sequence
  Synthetic oligonucleotide
uuuguaaaauccacagcuauaucct

SEQ ID NO: 2341 - DNA, 25 bp, Artificial Sequence
  Synthetic oligonucleotide
uuguaaaauccacagcuauaucctg

SEQ ID NO: 2342 - DNA, 25 bp, Artificial Sequence
  Synthetic oligonucleotide
uguaaaauccacagcuauauccuga

SEQ ID NO: 2343 - DNA, 25 bp, Artificial Sequence
  Synthetic oligonucleotide
guaaaauccacagcuauauccugat

SEQ ID NO: 2344 - DNA, 25 bp, Artificial Sequence
  Synthetic oligonucleotide
uaaaauccacagcuauauccugatg

SEQ ID NO: 2345 - DNA, 25 bp, Artificial Sequence
  Synthetic oligonucleotide
aaaauccacagcuauauccugaugc

SEQ ID NO: 2346 - DNA, 25 bp, Artificial Sequence
  Synthetic oligonucleotide
aaauccacagcuauauccugaugct

SEQ ID NO: 2347 - DNA, 25 bp, Artificial Sequence
  Synthetic oligonucleotide
aauccacagcuauauccugaugctg

SEQ ID NO: 2348 - DNA, 25 bp, Artificial Sequence
  Synthetic oligonucleotide
auccacagcuauauccugaugcugg

SEQ ID NO: 2349 - DNA, 25 bp, Artificial Sequence
  Synthetic oligonucleotide
uccacagcuauauccugaugcugga

SEQ ID NO: 2350 - DNA, 25 bp, Artificial Sequence
  Synthetic oligonucleotide
ccacagcuauauccugaugcuggat

SEQ ID NO: 2351 - DNA, 25 bp, Artificial Sequence
  Synthetic oligonucleotide
cacagcuauauccugaugcuggatg

SEQ ID NO: 2352 - DNA, 25 bp, Artificial Sequence
  Synthetic oligonucleotide
acagcuauauccugaugcuggaugg

SEQ ID NO: 2353 - DNA, 25 bp, Artificial Sequence
  Synthetic oligonucleotide
cagcuauauccugaugcuggauggt

SEQ ID NO: 2354 - DNA, 25 bp, Artificial Sequence
  Synthetic oligonucleotide
agcuauauccugaugcuggauggta

SEQ ID NO: 2355 - DNA, 25 bp, Artificial Sequence
  Synthetic oligonucleotide
gcuauauccugaugcuggaugguat

SEQ ID NO: 2356 - DNA, 25 bp, Artificial Sequence
  Synthetic oligonucleotide
cuauauccugaugcuggaugguatt

SEQ ID NO: 2357 - DNA, 25 bp, Artificial Sequence
  Synthetic oligonucleotide
uauauccugaugcuggaugguauta

SEQ ID NO: 2358 - DNA, 25 bp, Artificial Sequence
  Synthetic oligonucleotide
auauccugaugcuggaugguauuaa

SEQ ID NO: 2359 - DNA, 25 bp, Artificial Sequence
  Synthetic oligonucleotide
uauccugaugcuggaugguauuaat

SEQ ID NO: 2360 - DNA, 25 bp, Artificial Sequence
  Synthetic oligonucleotide
auccugaugcuggaugguauuaatc

SEQ ID NO: 2361 - DNA, 25 bp, Artificial Sequence
  Synthetic oligonucleotide
uccugaugcuggaugguauuaauct

SEQ ID NO: 2362 - DNA, 25 bp, Artificial Sequence
  Synthetic oligonucleotide
ccugaugcuggaugguauuaauctt

SEQ ID NO: 2363 - DNA, 25 bp, Artificial Sequence
  Synthetic oligonucleotide
cugaugcuggaugguauuaaucutg

SEQ ID NO: 2364 - DNA, 25 bp, Artificial Sequence
  Synthetic oligonucleotide
ugaugcuggaugguauuaaucuugt

SEQ ID NO: 2365 - DNA, 25 bp, Artificial Sequence
  Synthetic oligonucleotide
gaugcuggaugguauuaaucuugtg

SEQ ID NO: 2366 - DNA, 25 bp, Artificial Sequence
  Synthetic oligonucleotide
augcuggaugguauuaaucuugugt

SEQ ID NO: 2367 - DNA, 25 bp, Artificial Sequence
  Synthetic oligonucleotide
ugcuggaugguauuaaucuugugta

SEQ ID NO: 2368 - DNA, 25 bp, Artificial Sequence
  Synthetic oligonucleotide
gcuggaugguauuaaucuuguguag

SEQ ID NO: 2369 - DNA, 25 bp, Artificial Sequence
  Synthetic oligonucleotide
cuggaugguauuaaucuuguguagt

SEQ ID NO: 2370 - DNA, 25 bp, Artificial Sequence
  Synthetic oligonucleotide
uggaugguauuaaucuuguguagtc

SEQ ID NO: 2371 - DNA, 25 bp, Artificial Sequence
  Synthetic oligonucleotide
ggaugguauuaaucuuguguaguct

SEQ ID NO: 2372 - DNA, 25 bp, Artificial Sequence
  Synthetic oligonucleotide
gaugguauuaaucuuguguaguctt

SEQ ID NO: 2373 - DNA, 25 bp, Artificial Sequence
  Synthetic oligonucleotide
augguauuaaucuuguguagucutc

SEQ ID NO: 2374 - DNA, 25 bp, Artificial Sequence
  Synthetic oligonucleotide
ugguauuaaucuuguguagucuuca

SEQ ID NO: 2375 - DNA, 25 bp, Artificial Sequence
  Synthetic oligonucleotide
gguauuaaucuuguguagucuucaa

SEQ ID NO: 2376 - DNA, 25 bp, Artificial Sequence
  Synthetic oligonucleotide
guauuaaucuuguguagucuucaac

SEQ ID NO: 2377 - DNA, 25 bp, Artificial Sequence
  Synthetic oligonucleotide
uauuaaucuuguguagucuucaact

SEQ ID NO: 2378 - DNA, 25 bp, Artificial Sequence
  Synthetic oligonucleotide
auuaaucuuguguagucuucaactg

SEQ ID NO: 2379 - DNA, 25 bp, Artificial Sequence
  Synthetic oligonucleotide
uuaaucuuguguagucuucaacugg

SEQ ID NO: 2380 - DNA, 25 bp, Artificial Sequence
  Synthetic oligonucleotide
uaaucuuguguagucuucaacuggt

SEQ ID NO: 2381 - DNA, 25 bp, Artificial Sequence
  Synthetic oligonucleotide
aaucuuguguagucuucaacuggtt

SEQ ID NO: 2382 - DNA, 25 bp, Artificial Sequence
  Synthetic oligonucleotide
aucuuguguagucuucaacugguta

SEQ ID NO: 2383 - DNA, 25 bp, Artificial Sequence
  Synthetic oligonucleotide
ucuuguguagucuucaacugguuag

SEQ ID NO: 2384 - DNA, 25 bp, Artificial Sequence
  Synthetic oligonucleotide
cuuguguagucuucaacugguuagt

SEQ ID NO: 2385 - DNA, 25 bp, Artificial Sequence
  Synthetic oligonucleotide
uuguguagucuucaacugguuagtg

SEQ ID NO: 2386 - DNA, 25 bp, Artificial Sequence
  Synthetic oligonucleotide
uguguagucuucaacugguuagugt

SEQ ID NO: 2387 - DNA, 25 bp, Artificial Sequence
  Synthetic oligonucleotide
guguagucuucaacugguuagugtg

SEQ ID NO: 2388 - DNA, 25 bp, Artificial Sequence
  Synthetic oligonucleotide
uguagucuucaacugguuaguguga

SEQ ID NO: 2389 - DNA, 25 bp, Artificial Sequence
  Synthetic oligonucleotide
guagucuucaacugguuagugugaa

SEQ ID NO: 2390 - DNA, 25 bp, Artificial Sequence
  Synthetic oligonucleotide
uagucuucaacugguuagugugaaa

SEQ ID NO: 2391 - DNA, 25 bp, Artificial Sequence
  Synthetic oligonucleotide
agucuucaacugguuagugugaaat

SEQ ID NO: 2392 - DNA, 25 bp, Artificial Sequence
  Synthetic oligonucleotide
gucuucaacugguuagugugaaata

SEQ ID NO: 2393 - DNA, 25 bp, Artificial Sequence
  Synthetic oligonucleotide
ucuucaacugguuagugugaaauag

SEQ ID NO: 2394 - DNA, 25 bp, Artificial Sequence
  Synthetic oligonucleotide
cuucaacugguuagugugaaauagt

SEQ ID NO: 2395 - DNA, 25 bp, Artificial Sequence
  Synthetic oligonucleotide
uucaacugguuagugugaaauagtt

SEQ ID NO: 2396 - DNA, 25 bp, Artificial Sequence
  Synthetic oligonucleotide
ucaacugguuagugugaaauagutc

SEQ ID NO: 2397 - DNA, 25 bp, Artificial Sequence
  Synthetic oligonucleotide
caacugguuagugugaaauaguuct

SEQ ID NO: 2398 - DNA, 25 bp, Artificial Sequence
  Synthetic oligonucleotide
ugguuagugugaaauaguucugcca

SEQ ID NO: 2399 - DNA, 25 bp, Artificial Sequence
  Synthetic oligonucleotide
guuagugugaaauaguucugccacc

SEQ ID NO: 2400 - DNA, 25 bp, Artificial Sequence
  Synthetic oligonucleotide
uuagugugaaauaguucugccacct

SEQ ID NO: 2401 - DNA, 25 bp, Artificial Sequence
  Synthetic oligonucleotide
uagugugaaauaguucugccacctc

SEQ ID NO: 2402 - DNA, 25 bp, Artificial Sequence
  Synthetic oligonucleotide
agugugaaauaguucugccaccuct

SEQ ID NO: 2403 - DNA, 25 bp, Artificial Sequence
  Synthetic oligonucleotide
gugugaaauaguucugccaccuctg

SEQ ID NO: 2404 - DNA, 25 bp, Artificial Sequence
  Synthetic oligonucleotide
ugugaaauaguucugccaccucuga

SEQ ID NO: 2405 - DNA, 25 bp, Artificial Sequence
  Synthetic oligonucleotide
gugaaauaguucugccaccucugac

SEQ ID NO: 2406 - DNA, 25 bp, Artificial Sequence
  Synthetic oligonucleotide
ugaaauaguucugccaccucugacg

SEQ ID NO: 2407 - DNA, 25 bp, Artificial Sequence
  Synthetic oligonucleotide
gaaauaguucugccaccucugacgc

SEQ ID NO: 2408 - DNA, 25 bp, Artificial Sequence
  Synthetic oligonucleotide
aaauaguucugccaccucugacgca

SEQ ID NO: 2409 - DNA, 25 bp, Artificial Sequence
  Synthetic oligonucleotide
aauaguucugccaccucugacgcac

SEQ ID NO: 2410 - DNA, 25 bp, Artificial Sequence
  Synthetic oligonucleotide
auaguucugccaccucugacgcacc

SEQ ID NO: 2411 - DNA, 25 bp, Artificial Sequence
  Synthetic oligonucleotide
uaguucugccaccucugacgcacca

SEQ ID NO: 2412 - DNA, 25 bp, Artificial Sequence
  Synthetic oligonucleotide
aguucugccaccucugacgcaccac

SEQ ID NO: 2413 - DNA, 25 bp, Artificial Sequence
  Synthetic oligonucleotide
guucugccaccucugacgcaccact

SEQ ID NO: 2414 - DNA, 25 bp, Artificial Sequence
  Synthetic oligonucleotide
uucugccaccucugacgcaccactg

SEQ ID NO: 2415 - DNA, 25 bp, Artificial Sequence
  Synthetic oligonucleotide
ucugccaccucugacgcaccacugc

SEQ ID NO: 2416 - DNA, 25 bp, Artificial Sequence
  Synthetic oligonucleotide
cugccaccucugacgcaccacugcc

SEQ ID NO: 2417 - DNA, 25 bp, Artificial Sequence
  Synthetic oligonucleotide
ugccaccucugacgcaccacugcca

SEQ ID NO: 2418 - DNA, 25 bp, Artificial Sequence
  Synthetic oligonucleotide
gccaccucugacgcaccacugccaa

SEQ ID NO: 2419 - DNA, 25 bp, Artificial Sequence
  Synthetic oligonucleotide
ccaccucugacgcaccacugccaat

SEQ ID NO: 2420 - DNA, 25 bp, Artificial Sequence
  Synthetic oligonucleotide
caccucugacgcaccacugccaatg

SEQ ID NO: 2421 - DNA, 25 bp, Artificial Sequence
  Synthetic oligonucleotide
accucugacgcaccacugccaaugc

SEQ ID NO: 2422 - DNA, 25 bp, Artificial Sequence
  Synthetic oligonucleotide
ccucugacgcaccacugccaaugct

SEQ ID NO: 2423 - DNA, 25 bp, Artificial Sequence
  Synthetic oligonucleotide
cucugacgcaccacugccaaugctg

SEQ ID NO: 2424 - DNA, 25 bp, Artificial Sequence
  Synthetic oligonucleotide
ucugacgcaccacugccaaugcugt

SEQ ID NO: 2425 - DNA, 25 bp, Artificial Sequence
  Synthetic oligonucleotide
cugacgcaccacugccaaugcugta

SEQ ID NO: 2426 - DNA, 25 bp, Artificial Sequence
  Synthetic oligonucleotide
ugacgcaccacugccaaugcuguac

SEQ ID NO: 2427 - DNA, 25 bp, Artificial Sequence
  Synthetic oligonucleotide
gacgcaccacugccaaugcuguacg

SEQ ID NO: 2428 - DNA, 25 bp, Artificial Sequence
  Synthetic oligonucleotide
acgcaccacugccaaugcuguacgt

SEQ ID NO: 2429 - DNA, 25 bp, Artificial Sequence
  Synthetic oligonucleotide
cgcaccacugccaaugcuguacgta

SEQ ID NO: 2430 - DNA, 25 bp, Artificial Sequence
  Synthetic oligonucleotide
gcaccacugccaaugcuguacguac

SEQ ID NO: 2431 - DNA, 25 bp, Artificial Sequence
  Synthetic oligonucleotide
caccacugccaaugcuguacguact

SEQ ID NO: 2432 - DNA, 25 bp, Artificial Sequence
  Synthetic oligonucleotide
accacugccaaugcuguacguactg

SEQ ID NO: 2433 - DNA, 25 bp, Artificial Sequence
  Synthetic oligonucleotide
ccacugccaaugcuguacguacugc

SEQ ID NO: 2434 - DNA, 25 bp, Artificial Sequence
  Synthetic oligonucleotide
cacugccaaugcuguacguacugca

SEQ ID NO: 2435 - DNA, 25 bp, Artificial Sequence
  Synthetic oligonucleotide
acugccaaugcuguacguacugcat

SEQ ID NO: 2436 - DNA, 25 bp, Artificial Sequence
  Synthetic oligonucleotide
cugccaaugcuguacguacugcatt

SEQ ID NO: 2437 - DNA, 25 bp, Artificial Sequence
  Synthetic oligonucleotide
ugccaaugcuguacguacugcautt

SEQ ID NO: 2438 - DNA, 25 bp, Artificial Sequence
  Synthetic oligonucleotide
gccaaugcuguacguacugcauutg

SEQ ID NO: 2439 - DNA, 25 bp, Artificial Sequence
  Synthetic oligonucleotide
ccaaugcuguacguacugcauuugc

SEQ ID NO: 2440 - DNA, 25 bp, Artificial Sequence
  Synthetic oligonucleotide
caaugcuguacguacugcauuugcc

SEQ ID NO: 2441 - DNA, 25 bp, Artificial Sequence
  Synthetic oligonucleotide
aaugcuguacguacugcauuugccc

SEQ ID NO: 2442 - DNA, 25 bp, Artificial Sequence
  Synthetic oligonucleotide
augcuguacguacugcauuugcccc

SEQ ID NO: 2443 - DNA, 25 bp, Artificial Sequence
  Synthetic oligonucleotide
ugcuguacguacugcauuugcccct

SEQ ID NO: 2444 - DNA, 25 bp, Artificial Sequence
  Synthetic oligonucleotide
gcuguacguacugcauuugcccctt

SEQ ID NO: 2445 - DNA, 25 bp, Artificial Sequence
  Synthetic oligonucleotide
cuguacguacugcauuugccccutg

SEQ ID NO: 2446 - DNA, 25 bp, Artificial Sequence
  Synthetic oligonucleotide
uguacguacugcauuugccccuuga

SEQ ID NO: 2447 - DNA, 25 bp, Artificial Sequence
  Synthetic oligonucleotide
guacguacugcauuugccccuugag

SEQ ID NO: 2448 - DNA, 25 bp, Artificial Sequence
  Synthetic oligonucleotide
uacguacugcauuugccccuugagc

SEQ ID NO: 2449 - DNA, 25 bp, Artificial Sequence
  Synthetic oligonucleotide
acguacugcauuugccccuugagcc

SEQ ID NO: 2450 - DNA, 25 bp, Artificial Sequence
  Synthetic oligonucleotide
cguacugcauuugccccuugagcca

SEQ ID NO: 2451 - DNA, 25 bp, Artificial Sequence
  Synthetic oligonucleotide
guacugcauuugccccuugagccag

SEQ ID NO: 2452 - DNA, 25 bp, Artificial Sequence
  Synthetic oligonucleotide
uacugcauuugccccuugagccagg

SEQ ID NO: 2453 - DNA, 25 bp, Artificial Sequence
  Synthetic oligonucleotide
acugcauuugccccuugagccaggt

SEQ ID NO: 2454 - DNA, 25 bp, Artificial Sequence
  Synthetic oligonucleotide
cugcauuugccccuugagccaggtg

SEQ ID NO: 2455 - DNA, 25 bp, Artificial Sequence
  Synthetic oligonucleotide
ugcauuugccccuugagccaggugg

SEQ ID NO: 2456 - DNA, 25 bp, Artificial Sequence
  Synthetic oligonucleotide
gcauuugccccuugagccaggugga

SEQ ID NO: 2457 - DNA, 25 bp, Artificial Sequence
  Synthetic oligonucleotide
cauuugccccuugagccagguggat

SEQ ID NO: 2458 - DNA, 25 bp, Artificial Sequence
  Synthetic oligonucleotide
auuugccccuugagccagguggatg

SEQ ID NO: 2459 - DNA, 25 bp, Artificial Sequence
  Synthetic oligonucleotide
uuugccccuugagccagguggaugt

SEQ ID NO: 2460 - DNA, 25 bp, Artificial Sequence
  Synthetic oligonucleotide
uugccccuugagccagguggaugtt

SEQ ID NO: 2461 - DNA, 25 bp, Artificial Sequence
  Synthetic oligonucleotide
ugccccuugagccagguggaugutt

SEQ ID NO: 2462 - DNA, 25 bp, Artificial Sequence
  Synthetic oligonucleotide
gccccuugagccagguggauguuta

SEQ ID NO: 2463 - DNA, 25 bp, Artificial Sequence
  Synthetic oligonucleotide
ccccuugagccagguggauguuuac

SEQ ID NO: 2464 - DNA, 25 bp, Artificial Sequence
  Synthetic oligonucleotide
cccuugagccagguggauguuuacc

SEQ ID NO: 2465 - DNA, 25 bp, Artificial Sequence
  Synthetic oligonucleotide
ccuugagccagguggauguuuaccg

SEQ ID NO: 2466 - DNA, 25 bp, Artificial Sequence
  Synthetic oligonucleotide
cuugagccagguggauguuuaccgt

SEQ ID NO: 2467 - DNA, 25 bp, Artificial Sequence
  Synthetic oligonucleotide
uugagccagguggauguuuaccgtg

SEQ ID NO: 2468 - DNA, 25 bp, Artificial Sequence
  Synthetic oligonucleotide
ugagccagguggauguuuaccgugt

SEQ ID NO: 2469 - DNA, 25 bp, Artificial Sequence
  Synthetic oligonucleotide
gagccagguggauguuuaccgugtg

SEQ ID NO: 2470 - DNA, 25 bp, Artificial Sequence
  Synthetic oligonucleotide
agccagguggauguuuaccgugugt

SEQ ID NO: 2471 - DNA, 25 bp, Artificial Sequence
  Synthetic oligonucleotide
gccagguggauguuuaccgugugtt

SEQ ID NO: 2472 - DNA, 25 bp, Artificial Sequence
  Synthetic oligonucleotide
ccagguggauguuuaccguguguta

SEQ ID NO: 2473 - DNA, 25 bp, Artificial Sequence
  Synthetic oligonucleotide
cagguggauguuuaccguguguuat

SEQ ID NO: 2474 - DNA, 25 bp, Artificial Sequence
  Synthetic oligonucleotide
agguggauguuuaccguguguuata

SEQ ID NO: 2475 - DNA, 25 bp, Artificial Sequence
  Synthetic oligonucleotide
gguggauguuuaccguguguuauat

SEQ ID NO: 2476 - DNA, 25 bp, Artificial Sequence
  Synthetic oligonucleotide
guggauguuuaccguguguuauata

SEQ ID NO: 2477 - DNA, 25 bp, Artificial Sequence
  Synthetic oligonucleotide
uggauguuuaccguguguuauauaa

SEQ ID NO: 2478 - DNA, 25 bp, Artificial Sequence
  Synthetic oligonucleotide
ggauguuuaccguguguuauauaac

SEQ ID NO: 2479 - DNA, 25 bp, Artificial Sequence
  Synthetic oligonucleotide
gauguuuaccguguguuauauaact

SEQ ID NO: 2480 - DNA, 25 bp, Artificial Sequence
  Synthetic oligonucleotide
auguuuaccguguguuauauaactt

SEQ ID NO: 2481 - DNA, 25 bp, Artificial Sequence
  Synthetic oligonucleotide
uguuuaccguguguuauauaacutc

SEQ ID NO: 2482 - DNA, 25 bp, Artificial Sequence
  Synthetic oligonucleotide
guuuaccguguguuauauaacuucc

SEQ ID NO: 2483 - DNA, 25 bp, Artificial Sequence
  Synthetic oligonucleotide
uuuaccguguguuauauaacuucct

SEQ ID NO: 2484 - DNA, 25 bp, Artificial Sequence
  Synthetic oligonucleotide
uuaccguguguuauauaacuucctg

SEQ ID NO: 2485 - DNA, 25 bp, Artificial Sequence
  Synthetic oligonucleotide
uaccguguguuauauaacuuccugg

SEQ ID NO: 2486 - DNA, 25 bp, Artificial Sequence
  Synthetic oligonucleotide
accguguguuauauaacuuccuggc

SEQ ID NO: 2487 - DNA, 25 bp, Artificial Sequence
  Synthetic oligonucleotide
ccguguguuauauaacuuccuggct

SEQ ID NO: 2488 - DNA, 25 bp, Artificial Sequence
  Synthetic oligonucleotide
cguguguuauauaacuuccuggctc

SEQ ID NO: 2489 - DNA, 25 bp, Artificial Sequence
  Synthetic oligonucleotide
guguguuauauaacuuccuggcucc

SEQ ID NO: 2490 - DNA, 25 bp, Artificial Sequence
  Synthetic oligonucleotide
uguguuauauaacuuccuggcucct

SEQ ID NO: 2491 - DNA, 25 bp, Artificial Sequence
  Synthetic oligonucleotide
guguuauauaacuuccuggcucctt

SEQ ID NO: 2492 - DNA, 25 bp, Artificial Sequence
  Synthetic oligonucleotide
uguuauauaacuuccuggcuccutc

SEQ ID NO: 2493 - DNA, 25 bp, Artificial Sequence
  Synthetic oligonucleotide
guuauauaacuuccuggcuccuuca

SEQ ID NO: 2494 - DNA, 25 bp, Artificial Sequence
  Synthetic oligonucleotide
uuauauaacuuccuggcuccuucac

SEQ ID NO: 2495 - DNA, 25 bp, Artificial Sequence
  Synthetic oligonucleotide
uauauaacuuccuggcuccuucact

SEQ ID NO: 2496 - DNA, 25 bp, Artificial Sequence
  Synthetic oligonucleotide
auauaacuuccuggcuccuucactg

SEQ ID NO: 2497 - DNA, 25 bp, Artificial Sequence
  Synthetic oligonucleotide
uauaacuuccuggcuccuucacuga

SEQ ID NO: 2498 - DNA, 25 bp, Artificial Sequence
  Synthetic oligonucleotide
auaacuuccuggcuccuucacugaa

SEQ ID NO: 2499 - DNA, 25 bp, Artificial Sequence
  Synthetic oligonucleotide
uaacuuccuggcuccuucacugaac

SEQ ID NO: 2500 - DNA, 25 bp, Artificial Sequence
  Synthetic oligonucleotide
aacuuccuggcuccuucacugaaca

SEQ ID NO: 2501 - DNA, 25 bp, Artificial Sequence
  Synthetic oligonucleotide
acuuccuggcuccuucacugaacat

SEQ ID NO: 2502 - DNA, 25 bp, Artificial Sequence
  Synthetic oligonucleotide
cuuccuggcuccuucacugaacatg

SEQ ID NO: 2503 - DNA, 25 bp, Artificial Sequence
  Synthetic oligonucleotide
uuccuggcuccuucacugaacaugc

SEQ ID NO: 2504 - DNA, 25 bp, Artificial Sequence
  Synthetic oligonucleotide
uccuggcuccuucacugaacaugcc

SEQ ID NO: 2505 - DNA, 25 bp, Artificial Sequence
  Synthetic oligonucleotide
ccuggcuccuucacugaacaugcct

SEQ ID NO: 2506 - DNA, 25 bp, Artificial Sequence
  Synthetic oligonucleotide
cuggcuccuucacugaacaugccta

SEQ ID NO: 2507 - DNA, 25 bp, Artificial Sequence
  Synthetic oligonucleotide
uggcuccuucacugaacaugccuag

SEQ ID NO: 2508 - DNA, 25 bp, Artificial Sequence
  Synthetic oligonucleotide
ggcuccuucacugaacaugccuagt

SEQ ID NO: 2509 - DNA, 25 bp, Artificial Sequence
  Synthetic oligonucleotide
gcuccuucacugaacaugccuagtc

SEQ ID NO: 2510 - DNA, 25 bp, Artificial Sequence
  Synthetic oligonucleotide
cuccuucacugaacaugccuagucc

SEQ ID NO: 2511 - DNA, 25 bp, Artificial Sequence
  Synthetic oligonucleotide
uccuucacugaacaugccuagucca

SEQ ID NO: 2512 - DNA, 25 bp, Artificial Sequence
  Synthetic oligonucleotide
ccuucacugaacaugccuaguccaa

SEQ ID NO: 2513 - DNA, 25 bp, Artificial Sequence
  Synthetic oligonucleotide
cuucacugaacaugccuaguccaac

SEQ ID NO: 2514 - DNA, 25 bp, Artificial Sequence
  Synthetic oligonucleotide
uucacugaacaugccuaguccaaca

SEQ ID NO: 2515 - DNA, 25 bp, Artificial Sequence
  Synthetic oligonucleotide
ucacugaacaugccuaguccaacat

SEQ ID NO: 2516 - DNA, 25 bp, Artificial Sequence
  Synthetic oligonucleotide
cacugaacaugccuaguccaacatt

SEQ ID NO: 2517 - DNA, 25 bp, Artificial Sequence
  Synthetic oligonucleotide
acugaacaugccuaguccaacautt

SEQ ID NO: 2518 - DNA, 25 bp, Artificial Sequence
  Synthetic oligonucleotide
cugaacaugccuaguccaacauutt

SEQ ID NO: 2519 - DNA, 25 bp, Artificial Sequence
  Synthetic oligonucleotide
ugaacaugccuaguccaacauuutt

SEQ ID NO: 2520 - DNA, 25 bp, Artificial Sequence
  Synthetic oligonucleotide
gaacaugccuaguccaacauuuutt

SEQ ID NO: 2521 - DNA, 25 bp, Artificial Sequence
  Synthetic oligonucleotide
aacaugccuaguccaacauuuuutc

SEQ ID NO: 2522 - DNA, 25 bp, Artificial Sequence
  Synthetic oligonucleotide
acaugccuaguccaacauuuuuucc

SEQ ID NO: 2523 - DNA, 25 bp, Artificial Sequence
  Synthetic oligonucleotide
caugccuaguccaacauuuuuuccc

SEQ ID NO: 2524 - DNA, 25 bp, Artificial Sequence
  Synthetic oligonucleotide
augccuaguccaacauuuuuuccca

SEQ ID NO: 2525 - DNA, 25 bp, Artificial Sequence
  Synthetic oligonucleotide
ugccuaguccaacauuuuuucccag

SEQ ID NO: 2526 - DNA, 25 bp, Artificial Sequence
  Synthetic oligonucleotide
gccuaguccaacauuuuuucccagt

SEQ ID NO: 2527 - DNA, 25 bp, Artificial Sequence
  Synthetic oligonucleotide
ccuaguccaacauuuuuucccagtg

SEQ ID NO: 2528 - DNA, 25 bp, Artificial Sequence
  Synthetic oligonucleotide
cuaguccaacauuuuuucccaguga

SEQ ID NO: 2529 - DNA, 25 bp, Artificial Sequence
  Synthetic oligonucleotide
uaguccaacauuuuuucccagugag

SEQ ID NO: 2530 - DNA, 25 bp, Artificial Sequence
  Synthetic oligonucleotide
aguccaacauuuuuucccagugagt

SEQ ID NO: 2531 - DNA, 25 bp, Artificial Sequence
  Synthetic oligonucleotide
guccaacauuuuuucccagugagtc

SEQ ID NO: 2532 - DNA, 25 bp, Artificial Sequence
  Synthetic oligonucleotide
uccaacauuuuuucccagugaguca

SEQ ID NO: 2533 - DNA, 25 bp, Artificial Sequence
  Synthetic oligonucleotide
ccaacauuuuuucccagugagucac

SEQ ID NO: 2534 - DNA, 25 bp, Artificial Sequence
  Synthetic oligonucleotide
caacauuuuuucccagugagucaca

SEQ ID NO: 2535 - DNA, 25 bp, Artificial Sequence
  Synthetic oligonucleotide
aacauuuuuucccagugagucacat

SEQ ID NO: 2536 - DNA, 25 bp, Artificial Sequence
  Synthetic oligonucleotide
acauuuuuucccagugagucacatc

SEQ ID NO: 2537 - DNA, 25 bp, Artificial Sequence
  Synthetic oligonucleotide
cauuuuuucccagugagucacaucc

SEQ ID NO: 2538 - DNA, 25 bp, Artificial Sequence
  Synthetic oligonucleotide
auuuuuucccagugagucacaucct

SEQ ID NO: 2539 - DNA, 25 bp, Artificial Sequence
  Synthetic oligonucleotide
uuuuuucccagugagucacaucctg

SEQ ID NO: 2540 - DNA, 25 bp, Artificial Sequence
  Synthetic oligonucleotide
uuuuucccagugagucacauccugg

SEQ ID NO: 2541 - DNA, 25 bp, Artificial Sequence
  Synthetic oligonucleotide
uuuucccagugagucacauccuggg

SEQ ID NO: 2542 - DNA, 25 bp, Artificial Sequence
  Synthetic oligonucleotide
uuucccagugagucacauccuggga

SEQ ID NO: 2543 - DNA, 25 bp, Artificial Sequence
  Synthetic oligonucleotide
uucccagugagucacauccugggat

SEQ ID NO: 2544 - DNA, 25 bp, Artificial Sequence
  Synthetic oligonucleotide
ucccagugagucacauccugggatc

SEQ ID NO: 2545 - DNA, 25 bp, Artificial Sequence
  Synthetic oligonucleotide
cccagugagucacauccugggaucc

SEQ ID NO: 2546 - DNA, 25 bp, Artificial Sequence
  Synthetic oligonucleotide
ccagugagucacauccugggaucca

SEQ ID NO: 2547 - DNA, 25 bp, Artificial Sequence
  Synthetic oligonucleotide
cagugagucacauccugggauccag

SEQ ID NO: 2548 - DNA, 25 bp, Artificial Sequence
  Synthetic oligonucleotide
agugagucacauccugggauccagt

SEQ ID NO: 2549 - DNA, 25 bp, Artificial Sequence
  Synthetic oligonucleotide
gugagucacauccugggauccagtg

SEQ ID NO: 2550 - DNA, 25 bp, Artificial Sequence
  Synthetic oligonucleotide
ugagucacauccugggauccagugt

SEQ ID NO: 2551 - DNA, 25 bp, Artificial Sequence
  Synthetic oligonucleotide
gagucacauccugggauccagugta

SEQ ID NO: 2552 - DNA, 25 bp, Artificial Sequence
  Synthetic oligonucleotide
agucacauccugggauccaguguat

SEQ ID NO: 2553 - DNA, 25 bp, Artificial Sequence
  Synthetic oligonucleotide
gucacauccugggauccaguguata

SEQ ID NO: 2554 - DNA, 25 bp, Artificial Sequence
  Synthetic oligonucleotide
ucacauccugggauccaguguauaa

SEQ ID NO: 2555 - DNA, 25 bp, Artificial Sequence
  Synthetic oligonucleotide
cacauccugggauccaguguauaaa

SEQ ID NO: 2556 - DNA, 25 bp, Artificial Sequence
  Synthetic oligonucleotide
acauccugggauccaguguauaaat

SEQ ID NO: 2557 - DNA, 25 bp, Artificial Sequence
  Synthetic oligonucleotide
cauccugggauccaguguauaaatc

SEQ ID NO: 2558 - DNA, 25 bp, Artificial Sequence
  Synthetic oligonucleotide
auccugggauccaguguauaaaucc

SEQ ID NO: 2559 - DNA, 25 bp, Artificial Sequence
  Synthetic oligonucleotide
uccugggauccaguguauaaaucca

SEQ ID NO: 2560 - DNA, 25 bp, Artificial Sequence
  Synthetic oligonucleotide
ccugggauccaguguauaaauccaa

SEQ ID NO: 2561 - DNA, 25 bp, Artificial Sequence
  Synthetic oligonucleotide
cugggauccaguguauaaauccaat

SEQ ID NO: 2562 - DNA, 25 bp, Artificial Sequence
  Synthetic oligonucleotide
ugggauccaguguauaaauccaata

SEQ ID NO: 2563 - DNA, 25 bp, Artificial Sequence
  Synthetic oligonucleotide
gggauccaguguauaaauccaauat

SEQ ID NO: 2564 - DNA, 25 bp, Artificial Sequence
  Synthetic oligonucleotide
ggauccaguguauaaauccaauatc

SEQ ID NO: 2565 - DNA, 25 bp, Artificial Sequence
  Synthetic oligonucleotide
gauccaguguauaaauccaauauca

SEQ ID NO: 2566 - DNA, 25 bp, Artificial Sequence
  Synthetic oligonucleotide
uccaguguauaaauccaauaucatg

SEQ ID NO: 2567 - DNA, 25 bp, Artificial Sequence
  Synthetic oligonucleotide
ccaguguauaaauccaauaucaugt

SEQ ID NO: 2568 - DNA, 25 bp, Artificial Sequence
  Synthetic oligonucleotide
caguguauaaauccaauaucaugtc

SEQ ID NO: 2569 - DNA, 25 bp, Artificial Sequence
  Synthetic oligonucleotide
guguauaaauccaauaucauguctt

SEQ ID NO: 2570 - DNA, 25 bp, Artificial Sequence
  Synthetic oligonucleotide
uguauaaauccaauaucaugucutg

SEQ ID NO: 2571 - DNA, 25 bp, Artificial Sequence
  Synthetic oligonucleotide
guauaaauccaauaucaugucuugt

SEQ ID NO: 2572 - DNA, 25 bp, Artificial Sequence
  Synthetic oligonucleotide
uauaaauccaauaucaugucuugtg

SEQ ID NO: 2573 - DNA, 25 bp, Artificial Sequence
  Synthetic oligonucleotide
auaaauccaauaucaugucuugugc

SEQ ID NO: 2574 - DNA, 25 bp, Artificial Sequence
  Synthetic oligonucleotide
uaaauccaauaucaugucuugugca

SEQ ID NO: 2575 - DNA, 25 bp, Artificial Sequence
  Synthetic oligonucleotide
aaauccaauaucaugucuugugcat

SEQ ID NO: 2576 - DNA, 25 bp, Artificial Sequence
  Synthetic oligonucleotide
aauccaauaucaugucuugugcata

SEQ ID NO: 2577 - DNA, 25 bp, Artificial Sequence
  Synthetic oligonucleotide
auccaauaucaugucuugugcauaa

SEQ ID NO: 2578 - DNA, 25 bp, Artificial Sequence
  Synthetic oligonucleotide
uccaauaucaugucuugugcauaat

SEQ ID NO: 2579 - DNA, 25 bp, Artificial Sequence
  Synthetic oligonucleotide
ccaauaucaugucuugugcauaatt

SEQ ID NO: 2580 - DNA, 25 bp, Artificial Sequence
  Synthetic oligonucleotide
caauaucaugucuugugcauaautc

SEQ ID NO: 2581 - DNA, 25 bp, Artificial Sequence
  Synthetic oligonucleotide
aauaucaugucuugugcauaauuct

SEQ ID NO: 2582 - DNA, 25 bp, Artificial Sequence
  Synthetic oligonucleotide
auaucaugucuugugcauaauuctt

SEQ ID NO: 2583 - DNA, 25 bp, Artificial Sequence
  Synthetic oligonucleotide
uaucaugucuugugcauaauucutc

SEQ ID NO: 2584 - DNA, 25 bp, Artificial Sequence
  Synthetic oligonucleotide
aucaugucuugugcauaauucuucc

SEQ ID NO: 2585 - DNA, 25 bp, Artificial Sequence
  Synthetic oligonucleotide
ucaugucuugugcauaauucuucca

SEQ ID NO: 2586 - DNA, 25 bp, Artificial Sequence
  Synthetic oligonucleotide
caugucuugugcauaauucuuccaa

SEQ ID NO: 2587 - DNA, 25 bp, Artificial Sequence
  Synthetic oligonucleotide
augucuugugcauaauucuuccaaa

SEQ ID NO: 2588 - DNA, 25 bp, Artificial Sequence
  Synthetic oligonucleotide
ugucuugugcauaauucuuccaaag

SEQ ID NO: 2589 - DNA, 25 bp, Artificial Sequence
  Synthetic oligonucleotide
gucuugugcauaauucuuccaaagg

SEQ ID NO: 2590 - DNA, 25 bp, Artificial Sequence
  Synthetic oligonucleotide
ucuugugcauaauucuuccaaagga

SEQ ID NO: 2591 - DNA, 25 bp, Artificial Sequence
  Synthetic oligonucleotide
cuugugcauaauucuuccaaaggat

SEQ ID NO: 2592 - DNA, 25 bp, Artificial Sequence
  Synthetic oligonucleotide
uugugcauaauucuuccaaaggatc

SEQ ID NO: 2593 - DNA, 25 bp, Artificial Sequence
  Synthetic oligonucleotide
ugugcauaauucuuccaaaggauct

SEQ ID NO: 2594 - DNA, 25 bp, Artificial Sequence
  Synthetic oligonucleotide
gugcauaauucuuccaaaggauctt

SEQ ID NO: 2595 - DNA, 25 bp, Artificial Sequence
  Synthetic oligonucleotide
ugcauaauucuuccaaaggaucuta

SEQ ID NO: 2596 - DNA, 25 bp, Artificial Sequence
  Synthetic oligonucleotide
gcauaauucuuccaaaggaucuuat

SEQ ID NO: 2597 - DNA, 25 bp, Artificial Sequence
  Synthetic oligonucleotide
cauaauucuuccaaaggaucuuatt

SEQ ID NO: 2598 - DNA, 25 bp, Artificial Sequence
  Synthetic oligonucleotide
auaauucuuccaaaggaucuuautt

SEQ ID NO: 2599 - DNA, 25 bp, Artificial Sequence
  Synthetic oligonucleotide
uaauucuuccaaaggaucuuauutt

SEQ ID NO: 2600 - DNA, 25 bp, Artificial Sequence
  Synthetic oligonucleotide
aauucuuccaaaggaucuuauuutg

SEQ ID NO: 2601 - DNA, 25 bp, Artificial Sequence
  Synthetic oligonucleotide
auucuuccaaaggaucuuauuuugt

SEQ ID NO: 2602 - DNA, 25 bp, Artificial Sequence
  Synthetic oligonucleotide
uucuuccaaaggaucuuauuuugtg

SEQ ID NO: 2603 - DNA, 25 bp, Artificial Sequence
  Synthetic oligonucleotide
ucuuccaaaggaucuuauuuuguga

SEQ ID NO: 2604 - DNA, 25 bp, Artificial Sequence
  Synthetic oligonucleotide
cuuccaaaggaucuuauuuugugaa

SEQ ID NO: 2605 - DNA, 25 bp, Artificial Sequence
  Synthetic oligonucleotide
uuccaaaggaucuuauuuugugaac

SEQ ID NO: 2606 - DNA, 25 bp, Artificial Sequence
  Synthetic oligonucleotide
uccaaaggaucuuauuuugugaact

SEQ ID NO: 2607 - DNA, 25 bp, Artificial Sequence
  Synthetic oligonucleotide
ccaaaggaucuuauuuugugaacta

SEQ ID NO: 2608 - DNA, 25 bp, Artificial Sequence
  Synthetic oligonucleotide
caaaggaucuuauuuugugaacuat

SEQ ID NO: 2609 - DNA, 25 bp, Artificial Sequence
  Synthetic oligonucleotide
aaaggaucuuauuuugugaacuata

SEQ ID NO: 2610 - DNA, 25 bp, Artificial Sequence
  Synthetic oligonucleotide
aaggaucuuauuuugugaacuauat

SEQ ID NO: 2611 - DNA, 25 bp, Artificial Sequence
  Synthetic oligonucleotide
aggaucuuauuuugugaacuauatc

SEQ ID NO: 2612 - DNA, 25 bp, Artificial Sequence
  Synthetic oligonucleotide
ggaucuuauuuugugaacuauauca

SEQ ID NO: 2613 - DNA, 25 bp, Artificial Sequence
  Synthetic oligonucleotide
gaucuuauuuugugaacuauaucag

SEQ ID NO: 2614 - DNA, 25 bp, Artificial Sequence
  Synthetic oligonucleotide
aucuuauuuugugaacuauaucagt

SEQ ID NO: 2615 - DNA, 25 bp, Artificial Sequence
  Synthetic oligonucleotide
ucuuauuuugugaacuauaucagta

SEQ ID NO: 2616 - DNA, 25 bp, Artificial Sequence
  Synthetic oligonucleotide
uuauuuugugaacuauaucaguagt

SEQ ID NO: 2617 - DNA, 25 bp, Artificial Sequence
  Synthetic oligonucleotide
uauuuugugaacuauaucaguagtg

SEQ ID NO: 2618 - DNA, 25 bp, Artificial Sequence
  Synthetic oligonucleotide
auuuugugaacuauaucaguagugt

SEQ ID NO: 2619 - DNA, 25 bp, Artificial Sequence
  Synthetic oligonucleotide
uuuugugaacuauaucaguagugta

SEQ ID NO: 2620 - DNA, 25 bp, Artificial Sequence
  Synthetic oligonucleotide
uuugugaacuauaucaguaguguac

SEQ ID NO: 2621 - DNA, 25 bp, Artificial Sequence
  Synthetic oligonucleotide
uugugaacuauaucaguaguguaca

SEQ ID NO: 2622 - DNA, 25 bp, Artificial Sequence
  Synthetic oligonucleotide
ugugaacuauaucaguaguguacat

SEQ ID NO: 2623 - DNA, 25 bp, Artificial Sequence
  Synthetic oligonucleotide
gugaacuauaucaguaguguacatt

SEQ ID NO: 2624 - DNA, 25 bp, Artificial Sequence
  Synthetic oligonucleotide
ugaacuauaucaguaguguacauta

SEQ ID NO: 2625 - DNA, 25 bp, Artificial Sequence
  Synthetic oligonucleotide
gaacuauaucaguaguguacauuac

SEQ ID NO: 2626 - DNA, 25 bp, Artificial Sequence
  Synthetic oligonucleotide
aacuauaucaguaguguacauuacc

SEQ ID NO: 2627 - DNA, 25 bp, Artificial Sequence
  Synthetic oligonucleotide
acuauaucaguaguguacauuacca

SEQ ID NO: 2628 - DNA, 25 bp, Artificial Sequence
  Synthetic oligonucleotide
cuauaucaguaguguacauuaccat

SEQ ID NO: 2629 - DNA, 25 bp, Artificial Sequence
  Synthetic oligonucleotide
auaucaguaguguacauuaccauat

SEQ ID NO: 2630 - DNA, 25 bp, Artificial Sequence
  Synthetic oligonucleotide
uaucaguaguguacauuaccauata

SEQ ID NO: 2631 - DNA, 25 bp, Artificial Sequence
  Synthetic oligonucleotide
caguaguguacauuaccauauaatg

SEQ ID NO: 2632 - DNA, 25 bp, Artificial Sequence
  Synthetic oligonucleotide
aguaguguacauuaccauauaaugt

SEQ ID NO: 2633 - DNA, 25 bp, Artificial Sequence
  Synthetic oligonucleotide
guaguguacauuaccauauaaugta

SEQ ID NO: 2634 - DNA, 25 bp, Artificial Sequence
  Synthetic oligonucleotide
uaguguacauuaccauauaauguaa

SEQ ID NO: 2635 - DNA, 25 bp, Artificial Sequence
  Synthetic oligonucleotide
aguguacauuaccauauaauguaaa

SEQ ID NO: 2636 - DNA, 25 bp, Artificial Sequence
  Synthetic oligonucleotide
guguacauuaccauauaauguaaaa

SEQ ID NO: 2637 - DNA, 25 bp, Artificial Sequence
  Synthetic oligonucleotide
uguacauuaccauauaauguaaaaa

SEQ ID NO: 2638 - DNA, 25 bp, Artificial Sequence
  Synthetic oligonucleotide
guacauuaccauauaauguaaaaag

SEQ ID NO: 2639 - DNA, 25 bp, Artificial Sequence
  Synthetic oligonucleotide
uacauuaccauauaauguaaaaaga

SEQ ID NO: 2640 - DNA, 25 bp, Artificial Sequence
  Synthetic oligonucleotide
acauuaccauauaauguaaaaagat

SEQ ID NO: 2641 - DNA, 25 bp, Artificial Sequence
  Synthetic oligonucleotide
cauuaccauauaauguaaaaagatc

SEQ ID NO: 2642 - DNA, 25 bp, Artificial Sequence
  Synthetic oligonucleotide
auuaccauauaauguaaaaagauct

SEQ ID NO: 2643 - DNA, 25 bp, Artificial Sequence
  Synthetic oligonucleotide
uuaccauauaauguaaaaagaucta

SEQ ID NO: 2644 - DNA, 25 bp, Artificial Sequence
  Synthetic oligonucleotide
uaccauauaauguaaaaagaucuac

SEQ ID NO: 2645 - DNA, 25 bp, Artificial Sequence
  Synthetic oligonucleotide
accauauaauguaaaaagaucuaca

SEQ ID NO: 2646 - DNA, 25 bp, Artificial Sequence
  Synthetic oligonucleotide
ccauauaauguaaaaagaucuacat

SEQ ID NO: 2647 - DNA, 25 bp, Artificial Sequence
  Synthetic oligonucleotide
cauauaauguaaaaagaucuacata

SEQ ID NO: 2648 - DNA, 25 bp, Artificial Sequence
  Synthetic oligonucleotide
auauaauguaaaaagaucuacauac

SEQ ID NO: 2649 - DNA, 25 bp, Artificial Sequence
  Synthetic oligonucleotide
uauaauguaaaaagaucuacauaca

SEQ ID NO: 2650 - DNA, 25 bp, Artificial Sequence
  Synthetic oligonucleotide
auaauguaaaaagaucuacauacaa

SEQ ID NO: 2651 - DNA, 25 bp, Artificial Sequence
  Synthetic oligonucleotide
uaauguaaaaagaucuacauacaaa

SEQ ID NO: 2652 - DNA, 25 bp, Artificial Sequence
  Synthetic oligonucleotide
aauguaaaaagaucuacauacaaac

SEQ ID NO: 2653 - DNA, 25 bp, Artificial Sequence
  Synthetic oligonucleotide
auguaaaaagaucuacauacaaaca

SEQ ID NO: 2654 - DNA, 25 bp, Artificial Sequence
  Synthetic oligonucleotide
uguaaaaagaucuacauacaaacaa

SEQ ID NO: 2655 - DNA, 25 bp, Artificial Sequence
  Synthetic oligonucleotide
guaaaaagaucuacauacaaacaat

SEQ ID NO: 2656 - DNA, 25 bp, Artificial Sequence
  Synthetic oligonucleotide
uaaaaagaucuacauacaaacaatg

SEQ ID NO: 2657 - DNA, 25 bp, Artificial Sequence
  Synthetic oligonucleotide
aaaaagaucuacauacaaacaaugc

SEQ ID NO: 2658 - DNA, 25 bp, Artificial Sequence
  Synthetic oligonucleotide
aaaagaucuacauacaaacaaugca

SEQ ID NO: 2659 - DNA, 25 bp, Artificial Sequence
  Synthetic oligonucleotide
aaagaucuacauacaaacaaugcaa

SEQ ID NO: 2660 - DNA, 25 bp, Artificial Sequence
  Synthetic oligonucleotide
aagaucuacauacaaacaaugcaac

SEQ ID NO: 2661 - DNA, 25 bp, Artificial Sequence
  Synthetic oligonucleotide
agaucuacauacaaacaaugcaacc

SEQ ID NO: 2662 - DNA, 25 bp, Artificial Sequence
  Synthetic oligonucleotide
gaucuacauacaaacaaugcaacca

SEQ ID NO: 2663 - DNA, 25 bp, Artificial Sequence
  Synthetic oligonucleotide
aucuacauacaaacaaugcaaccaa

SEQ ID NO: 2664 - DNA, 25 bp, Artificial Sequence
  Synthetic oligonucleotide
ucuacauacaaacaaugcaaccaac

SEQ ID NO: 2665 - DNA, 25 bp, Artificial Sequence
  Synthetic oligonucleotide
cuacauacaaacaaugcaaccaact

SEQ ID NO: 2666 - DNA, 25 bp, Artificial Sequence
  Synthetic oligonucleotide
uacauacaaacaaugcaaccaacta

SEQ ID NO: 2667 - DNA, 25 bp, Artificial Sequence
  Synthetic oligonucleotide
acauacaaacaaugcaaccaacuat

SEQ ID NO: 2668 - DNA, 25 bp, Artificial Sequence
  Synthetic oligonucleotide
cauacaaacaaugcaaccaacuatc

SEQ ID NO: 2669 - DNA, 25 bp, Artificial Sequence
  Synthetic oligonucleotide
auacaaacaaugcaaccaacuaucc

SEQ ID NO: 2670 - DNA, 25 bp, Artificial Sequence
  Synthetic oligonucleotide
uacaaacaaugcaaccaacuaucca

SEQ ID NO: 2671 - DNA, 25 bp, Artificial Sequence
  Synthetic oligonucleotide
acaaacaaugcaaccaacuauccaa

SEQ ID NO: 2672 - DNA, 25 bp, Artificial Sequence
  Synthetic oligonucleotide
caaacaaugcaaccaacuauccaag

SEQ ID NO: 2673 - DNA, 25 bp, Artificial Sequence
  Synthetic oligonucleotide
aaacaaugcaaccaacuauccaagt

SEQ ID NO: 2674 - DNA, 25 bp, Artificial Sequence
  Synthetic oligonucleotide
aacaaugcaaccaacuauccaagtg

SEQ ID NO: 2675 - DNA, 25 bp, Artificial Sequence
  Synthetic oligonucleotide
acaaugcaaccaacuauccaagugt

SEQ ID NO: 2676 - DNA, 25 bp, Artificial Sequence
  Synthetic oligonucleotide
caaugcaaccaacuauccaagugtt

SEQ ID NO: 2677 - DNA, 25 bp, Artificial Sequence
  Synthetic oligonucleotide
aaugcaaccaacuauccaaguguta

SEQ ID NO: 2678 - DNA, 25 bp, Artificial Sequence
  Synthetic oligonucleotide
augcaaccaacuauccaaguguuat

SEQ ID NO: 2679 - DNA, 25 bp, Artificial Sequence
  Synthetic oligonucleotide
ugcaaccaacuauccaaguguuata

SEQ ID NO: 2680 - DNA, 25 bp, Artificial Sequence
  Synthetic oligonucleotide
gcaaccaacuauccaaguguuauac

SEQ ID NO: 2681 - DNA, 25 bp, Artificial Sequence
  Synthetic oligonucleotide
caacuauccaaguguuauaccaact

SEQ ID NO: 2682 - DNA, 25 bp, Artificial Sequence
  Synthetic oligonucleotide
aacuauccaaguguuauaccaacta

SEQ ID NO: 2683 - DNA, 25 bp, Artificial Sequence
  Synthetic oligonucleotide
uauccaaguguuauaccaacuaaaa

SEQ ID NO: 2684 - DNA, 25 bp, Artificial Sequence
  Synthetic oligonucleotide
auccaaguguuauaccaacuaaaac

SEQ ID NO: 2685 - DNA, 25 bp, Artificial Sequence
  Synthetic oligonucleotide
caaguguuauaccaacuaaaacccc

SEQ ID NO: 2686 - DNA, 25 bp, Artificial Sequence
  Synthetic oligonucleotide
aaguguuauaccaacuaaaaccccc

SEQ ID NO: 2687 - DNA, 25 bp, Artificial Sequence
  Synthetic oligonucleotide
aguguuauaccaacuaaaaccccca

SEQ ID NO: 2688 - DNA, 25 bp, Artificial Sequence
  Synthetic oligonucleotide
guguuauaccaacuaaaacccccaa

SEQ ID NO: 2689 - DNA, 25 bp, Artificial Sequence
  Synthetic oligonucleotide
uguuauaccaacuaaaacccccaat

SEQ ID NO: 2690 - DNA, 25 bp, Artificial Sequence
  Synthetic oligonucleotide
guuauaccaacuaaaacccccaata

SEQ ID NO: 2691 - DNA, 25 bp, Artificial Sequence
  Synthetic oligonucleotide
uuauaccaacuaaaacccccaauaa

SEQ ID NO: 2692 - DNA, 25 bp, Artificial Sequence
  Synthetic oligonucleotide
uauaccaacuaaaacccccaauaaa

SEQ ID NO: 2693 - DNA, 25 bp, Artificial Sequence
  Synthetic oligonucleotide
auaccaacuaaaacccccaauaaac

SEQ ID NO: 2694 - DNA, 25 bp, Artificial Sequence
  Synthetic oligonucleotide
uaccaacuaaaacccccaauaaacc

SEQ ID NO: 2695 - DNA, 25 bp, Artificial Sequence
  Synthetic oligonucleotide
accaacuaaaacccccaauaaacct

SEQ ID NO: 2696 - DNA, 25 bp, Artificial Sequence
  Synthetic oligonucleotide
ccaacuaaaacccccaauaaacctt

SEQ ID NO: 2697 - DNA, 25 bp, Artificial Sequence
  Synthetic oligonucleotide
caacuaaaacccccaauaaaccutg

SEQ ID NO: 2698 - DNA, 25 bp, Artificial Sequence
  Synthetic oligonucleotide
aacuaaaacccccaauaaaccuuga

SEQ ID NO: 2699 - DNA, 25 bp, Artificial Sequence
  Synthetic oligonucleotide
acuaaaacccccaauaaaccuugaa

SEQ ID NO: 2700 - DNA, 25 bp, Artificial Sequence
  Synthetic oligonucleotide
cuaaaacccccaauaaaccuugaac

SEQ ID NO: 2701 - DNA, 25 bp, Artificial Sequence
  Synthetic oligonucleotide
uaaaacccccaauaaaccuugaaca

SEQ ID NO: 2702 - DNA, 25 bp, Artificial Sequence
  Synthetic oligonucleotide
aaaacccccaauaaaccuugaacag

SEQ ID NO: 2703 - DNA, 25 bp, Artificial Sequence
  Synthetic oligonucleotide
aaacccccaauaaaccuugaacagt

SEQ ID NO: 2704 - DNA, 25 bp, Artificial Sequence
  Synthetic oligonucleotide
aacccccaauaaaccuugaacagtg

SEQ ID NO: 2705 - DNA, 25 bp, Artificial Sequence
  Synthetic oligonucleotide
acccccaauaaaccuugaacaguga

SEQ ID NO: 2706 - DNA, 25 bp, Artificial Sequence
  Synthetic oligonucleotide
cccccaauaaaccuugaacagugac

SEQ ID NO: 2707 - DNA, 25 bp, Artificial Sequence
  Synthetic oligonucleotide
ccccaauaaaccuugaacagugact

SEQ ID NO: 2708 - DNA, 25 bp, Artificial Sequence
  Synthetic oligonucleotide
cccaauaaaccuugaacagugacta

SEQ ID NO: 2709 - DNA, 25 bp, Artificial Sequence
  Synthetic oligonucleotide
ccaauaaaccuugaacagugacuac

SEQ ID NO: 2710 - DNA, 25 bp, Artificial Sequence
  Synthetic oligonucleotide
caauaaaccuugaacagugacuact

SEQ ID NO: 2711 - DNA, 25 bp, Artificial Sequence
  Synthetic oligonucleotide
aauaaaccuugaacagugacuactt

SEQ ID NO: 2712 - DNA, 25 bp, Artificial Sequence
  Synthetic oligonucleotide
auaaaccuugaacagugacuacutt

SEQ ID NO: 2713 - DNA, 25 bp, Artificial Sequence
  Synthetic oligonucleotide
uaaaccuugaacagugacuacuutg

SEQ ID NO: 2714 - DNA, 25 bp, Artificial Sequence
  Synthetic oligonucleotide
aaaccuugaacagugacuacuuugg

SEQ ID NO: 2715 - DNA, 25 bp, Artificial Sequence
  Synthetic oligonucleotide
aaccuugaacagugacuacuuuggt

SEQ ID NO: 2716 - DNA, 25 bp, Artificial Sequence
  Synthetic oligonucleotide
accuugaacagugacuacuuuggtt

SEQ ID NO: 2717 - DNA, 25 bp, Artificial Sequence
  Synthetic oligonucleotide
ccuugaacagugacuacuuugguta

SEQ ID NO: 2718 - DNA, 25 bp, Artificial Sequence
  Synthetic oligonucleotide
cuugaacagugacuacuuugguuaa

SEQ ID NO: 2719 - DNA, 25 bp, Artificial Sequence
  Synthetic oligonucleotide
uugaacagugacuacuuugguuaat

SEQ ID NO: 2720 - DNA, 25 bp, Artificial Sequence
  Synthetic oligonucleotide
ugaacagugacuacuuugguuaatt

SEQ ID NO: 2721 - DNA, 25 bp, Artificial Sequence
  Synthetic oligonucleotide
gaacagugacuacuuugguuaautc

SEQ ID NO: 2722 - DNA, 25 bp, Artificial Sequence
  Synthetic oligonucleotide
aacagugacuacuuugguuaauuca

SEQ ID NO: 2723 - DNA, 25 bp, Artificial Sequence
  Synthetic oligonucleotide
acagugacuacuuugguuaauucat

SEQ ID NO: 2724 - DNA, 25 bp, Artificial Sequence
  Synthetic oligonucleotide
cagugacuacuuugguuaauucatt

SEQ ID NO: 2725 - DNA, 25 bp, Artificial Sequence
  Synthetic oligonucleotide
agugacuacuuugguuaauucauta

SEQ ID NO: 2726 - DNA, 25 bp, Artificial Sequence
  Synthetic oligonucleotide
gugacuacuuugguuaauucauuat

SEQ ID NO: 2727 - DNA, 25 bp, Artificial Sequence
  Synthetic oligonucleotide
ugacuacuuugguuaauucauuata

SEQ ID NO: 2728 - DNA, 25 bp, Artificial Sequence
  Synthetic oligonucleotide
gacuacuuugguuaauucauuauat

SEQ ID NO: 2729 - DNA, 25 bp, Artificial Sequence
  Synthetic oligonucleotide
acuacuuugguuaauucauuauatt

SEQ ID NO: 2730 - DNA, 25 bp, Artificial Sequence
  Synthetic oligonucleotide
cuacuuugguuaauucauuauauta

SEQ ID NO: 2731 - DNA, 25 bp, Artificial Sequence
  Synthetic oligonucleotide
uacuuugguuaauucauuauauuaa

SEQ ID NO: 2732 - DNA, 25 bp, Artificial Sequence
  Synthetic oligonucleotide
acuuugguuaauucauuauauuaag

SEQ ID NO: 2733 - DNA, 25 bp, Artificial Sequence
  Synthetic oligonucleotide
cuuugguuaauucauuauauuaaga

SEQ ID NO: 2734 - DNA, 25 bp, Artificial Sequence
  Synthetic oligonucleotide
uuugguuaauucauuauauuaagat

SEQ ID NO: 2735 - DNA, 25 bp, Artificial Sequence
  Synthetic oligonucleotide
uugguuaauucauuauauuaagata

SEQ ID NO: 2736 - DNA, 25 bp, Artificial Sequence
  Synthetic oligonucleotide
ugguuaauucauuauauuaagauat

SEQ ID NO: 2737 - DNA, 25 bp, Artificial Sequence
  Synthetic oligonucleotide
gguuaauucauuauauuaagauata

SEQ ID NO: 2738 - DNA, 25 bp, Artificial Sequence
  Synthetic oligonucleotide
guuaauucauuauauuaagauauaa

SEQ ID NO: 2739 - DNA, 25 bp, Artificial Sequence
  Synthetic oligonucleotide
uuaauucauuauauuaagauauaaa

SEQ ID NO: 2740 - DNA, 25 bp, Artificial Sequence
  Synthetic oligonucleotide
uaauucauuauauuaagauauaaag

SEQ ID NO: 2741 - DNA, 25 bp, Artificial Sequence
  Synthetic oligonucleotide
aauucauuauauuaagauauaaagt

SEQ ID NO: 2742 - DNA, 25 bp, Artificial Sequence
  Synthetic oligonucleotide
auucauuauauuaagauauaaagtc

SEQ ID NO: 2743 - DNA, 25 bp, Artificial Sequence
  Synthetic oligonucleotide
uucauuauauuaagauauaaaguca

SEQ ID NO: 2744 - DNA, 25 bp, Artificial Sequence
  Synthetic oligonucleotide
ucauuauauuaagauauaaagucat

SEQ ID NO: 2745 - DNA, 25 bp, Artificial Sequence
  Synthetic oligonucleotide
cauuauauuaagauauaaagucata

SEQ ID NO: 2746 - DNA, 25 bp, Artificial Sequence
  Synthetic oligonucleotide
auuauauuaagauauaaagucauaa

SEQ ID NO: 2747 - DNA, 25 bp, Artificial Sequence
  Synthetic oligonucleotide
uuauauuaagauauaaagucauaaa

SEQ ID NO: 2748 - DNA, 25 bp, Artificial Sequence
  Synthetic oligonucleotide
uauauuaagauauaaagucauaaag

SEQ ID NO: 2749 - DNA, 25 bp, Artificial Sequence
  Synthetic oligonucleotide
auauuaagauauaaagucauaaagc

SEQ ID NO: 2750 - DNA, 25 bp, Artificial Sequence
  Synthetic oligonucleotide
uauuaagauauaaagucauaaagct

SEQ ID NO: 2751 - DNA, 25 bp, Artificial Sequence
  Synthetic oligonucleotide
auuaagauauaaagucauaaagctg

SEQ ID NO: 2752 - DNA, 25 bp, Artificial Sequence
  Synthetic oligonucleotide
uuaagauauaaagucauaaagcugc

SEQ ID NO: 2753 - DNA, 25 bp, Artificial Sequence
  Synthetic oligonucleotide
uaagauauaaagucauaaagcugct

SEQ ID NO: 2754 - DNA, 25 bp, Artificial Sequence
  Synthetic oligonucleotide
aagauauaaagucauaaagcugcta

SEQ ID NO: 2755 - DNA, 25 bp, Artificial Sequence
  Synthetic oligonucleotide
agauauaaagucauaaagcugcuag

SEQ ID NO: 2756 - DNA, 25 bp, Artificial Sequence
  Synthetic oligonucleotide
gauauaaagucauaaagcugcuagt

SEQ ID NO: 2757 - DNA, 25 bp, Artificial Sequence
  Synthetic oligonucleotide
auauaaagucauaaagcugcuagtt

SEQ ID NO: 2758 - DNA, 25 bp, Artificial Sequence
  Synthetic oligonucleotide
uauaaagucauaaagcugcuaguta

SEQ ID NO: 2759 - DNA, 25 bp, Artificial Sequence
  Synthetic oligonucleotide
auaaagucauaaagcugcuaguuat

SEQ ID NO: 2760 - DNA, 25 bp, Artificial Sequence
  Synthetic oligonucleotide
uaaagucauaaagcugcuaguuatt

SEQ ID NO: 2761 - DNA, 25 bp, Artificial Sequence
  Synthetic oligonucleotide
aaagucauaaagcugcuaguuauta

SEQ ID NO: 2762 - DNA, 25 bp, Artificial Sequence
  Synthetic oligonucleotide
aagucauaaagcugcuaguuauuat

SEQ ID NO: 2763 - DNA, 25 bp, Artificial Sequence
  Synthetic oligonucleotide
agucauaaagcugcuaguuauuata

SEQ ID NO: 2764 - DNA, 25 bp, Artificial Sequence
  Synthetic oligonucleotide
gucauaaagcugcuaguuauuauat

SEQ ID NO: 2765 - DNA, 25 bp, Artificial Sequence
  Synthetic oligonucleotide
ucauaaagcugcuaguuauuauatt

SEQ ID NO: 2766 - DNA, 25 bp, Artificial Sequence
  Synthetic oligonucleotide
cauaaagcugcuaguuauuauauta

SEQ ID NO: 2767 - DNA, 25 bp, Artificial Sequence
  Synthetic oligonucleotide
auaaagcugcuaguuauuauauuaa

SEQ ID NO: 2768 - DNA, 25 bp, Artificial Sequence
  Synthetic oligonucleotide
uaaagcugcuaguuauuauauuaat

SEQ ID NO: 2769 - DNA, 25 bp, Artificial Sequence
  Synthetic oligonucleotide
aaagcugcuaguuauuauauuaatt

SEQ ID NO: 2770 - DNA, 25 bp, Artificial Sequence
  Synthetic oligonucleotide
aagcugcuaguuauuauauuaautt

SEQ ID NO: 2771 - DNA, 25 bp, Artificial Sequence
  Synthetic oligonucleotide
agcugcuaguuauuauauuaauutg

SEQ ID NO: 2772 - DNA, 25 bp, Artificial Sequence
  Synthetic oligonucleotide
gcugcuaguuauuauauuaauuugg

SEQ ID NO: 2773 - DNA, 25 bp, Artificial Sequence
  Synthetic oligonucleotide
cugcuaguuauuauauuaauuugga

SEQ ID NO: 2774 - DNA, 25 bp, Artificial Sequence
  Synthetic oligonucleotide
ugcuaguuauuauauuaauuuggaa

SEQ ID NO: 2775 - DNA, 25 bp, Artificial Sequence
  Synthetic oligonucleotide
gcuaguuauuauauuaauuuggaaa

SEQ ID NO: 2776 - DNA, 25 bp, Artificial Sequence
  Synthetic oligonucleotide
cuaguuauuauauuaauuuggaaat

SEQ ID NO: 2777 - DNA, 25 bp, Artificial Sequence
  Synthetic oligonucleotide
uaguuauuauauuaauuuggaaata

SEQ ID NO: 2778 - DNA, 25 bp, Artificial Sequence
  Synthetic oligonucleotide
aguuauuauauuaauuuggaaauat

SEQ ID NO: 2779 - DNA, 25 bp, Artificial Sequence
  Synthetic oligonucleotide
guuauuauauuaauuuggaaauatt

SEQ ID NO: 2780 - DNA, 25 bp, Artificial Sequence
  Synthetic oligonucleotide
uuauuauauuaauuuggaaauauta

SEQ ID NO: 2781 - DNA, 25 bp, Artificial Sequence
  Synthetic oligonucleotide
uauuauauuaauuuggaaauauuag

SEQ ID NO: 2782 - DNA, 25 bp, Artificial Sequence
  Synthetic oligonucleotide
auuauauuaauuuggaaauauuagg

SEQ ID NO: 2783 - DNA, 25 bp, Artificial Sequence
  Synthetic oligonucleotide
uuauauuaauuuggaaauauuaggc

SEQ ID NO: 2784 - DNA, 25 bp, Artificial Sequence
  Synthetic oligonucleotide
uauauuaauuuggaaauauuaggct

SEQ ID NO: 2785 - DNA, 25 bp, Artificial Sequence
  Synthetic oligonucleotide
auauuaauuuggaaauauuaggcta

SEQ ID NO: 2786 - DNA, 25 bp, Artificial Sequence
  Synthetic oligonucleotide
uauuaauuuggaaauauuaggcuat

SEQ ID NO: 2787 - DNA, 25 bp, Artificial Sequence
  Synthetic oligonucleotide
auuaauuuggaaauauuaggcuatt

SEQ ID NO: 2788 - DNA, 25 bp, Artificial Sequence
  Synthetic oligonucleotide
uuaauuuggaaauauuaggcuautc

SEQ ID NO: 2789 - DNA, 25 bp, Artificial Sequence
  Synthetic oligonucleotide
uaauuuggaaauauuaggcuauuct

SEQ ID NO: 2790 - DNA, 25 bp, Artificial Sequence
  Synthetic oligonucleotide
aauuuggaaauauuaggcuauuctt

SEQ ID NO: 2791 - DNA, 25 bp, Artificial Sequence
  Synthetic oligonucleotide
auuuggaaauauuaggcuauucutg

SEQ ID NO: 2792 - DNA, 25 bp, Artificial Sequence
  Synthetic oligonucleotide
uuuggaaauauuaggcuauucuugg

SEQ ID NO: 2793 - DNA, 25 bp, Artificial Sequence
  Synthetic oligonucleotide
uuggaaauauuaggcuauucuuggg

SEQ ID NO: 2794 - DNA, 25 bp, Artificial Sequence
  Synthetic oligonucleotide
uggaaauauuaggcuauucuugggc

SEQ ID NO: 2795 - DNA, 25 bp, Artificial Sequence
  Synthetic oligonucleotide
ggaaauauuaggcuauucuugggca

SEQ ID NO: 2796 - DNA, 25 bp, Artificial Sequence
  Synthetic oligonucleotide
gaaauauuaggcuauucuugggcaa

SEQ ID NO: 2797 - DNA, 25 bp, Artificial Sequence
  Synthetic oligonucleotide
aaauauuaggcuauucuugggcaac

SEQ ID NO: 2798 - DNA, 25 bp, Artificial Sequence
  Synthetic oligonucleotide
aauauuaggcuauucuugggcaacc

SEQ ID NO: 2799 - DNA, 25 bp, Artificial Sequence
  Synthetic oligonucleotide
auauuaggcuauucuugggcaaccc

SEQ ID NO: 2800 - DNA, 25 bp, Artificial Sequence
  Synthetic oligonucleotide
uauuaggcuauucuugggcaaccct

SEQ ID NO: 2801 - DNA, 25 bp, Artificial Sequence
  Synthetic oligonucleotide
auuaggcuauucuugggcaaccctg

SEQ ID NO: 2802 - DNA, 25 bp, Artificial Sequence
  Synthetic oligonucleotide
uuaggcuauucuugggcaacccugc

SEQ ID NO: 2803 - DNA, 25 bp, Artificial Sequence
  Synthetic oligonucleotide
uaggcuauucuugggcaacccugca

SEQ ID NO: 2804 - DNA, 25 bp, Artificial Sequence
  Synthetic oligonucleotide
aggcuauucuugggcaacccugcaa

SEQ ID NO: 2805 - DNA, 25 bp, Artificial Sequence
  Synthetic oligonucleotide
ggcuauucuugggcaacccugcaac

SEQ ID NO: 2806 - DNA, 25 bp, Artificial Sequence
  Synthetic oligonucleotide
gcuauucuugggcaacccugcaacg

SEQ ID NO: 2807 - DNA, 25 bp, Artificial Sequence
  Synthetic oligonucleotide
cuauucuugggcaacccugcaacga

SEQ ID NO: 2808 - DNA, 25 bp, Artificial Sequence
  Synthetic oligonucleotide
uauucuugggcaacccugcaacgat

SEQ ID NO: 2809 - DNA, 25 bp, Artificial Sequence
  Synthetic oligonucleotide
auucuugggcaacccugcaacgatt

SEQ ID NO: 2810 - DNA, 25 bp, Artificial Sequence
  Synthetic oligonucleotide
uucuugggcaacccugcaacgautt

SEQ ID NO: 2811 - DNA, 25 bp, Artificial Sequence
  Synthetic oligonucleotide
ucuugggcaacccugcaacgauutt

SEQ ID NO: 2812 - DNA, 25 bp, Artificial Sequence
  Synthetic oligonucleotide
cuugggcaacccugcaacgauuutt

SEQ ID NO: 2813 - DNA, 25 bp, Artificial Sequence
  Synthetic oligonucleotide
uugggcaacccugcaacgauuuutt

SEQ ID NO: 2814 - DNA, 25 bp, Artificial Sequence
  Synthetic oligonucleotide
ugggcaacccugcaacgauuuuutc

SEQ ID NO: 2815 - DNA, 25 bp, Artificial Sequence
  Synthetic oligonucleotide
gggcaacccugcaacgauuuuuuct

SEQ ID NO: 2816 - DNA, 25 bp, Artificial Sequence
  Synthetic oligonucleotide
ggcaacccugcaacgauuuuuucta

SEQ ID NO: 2817 - DNA, 25 bp, Artificial Sequence
  Synthetic oligonucleotide
gcaacccugcaacgauuuuuucuaa

SEQ ID NO: 2818 - DNA, 25 bp, Artificial Sequence
  Synthetic oligonucleotide
caacccugcaacgauuuuuucuaac

SEQ ID NO: 2819 - DNA, 25 bp, Artificial Sequence
  Synthetic oligonucleotide
aacccugcaacgauuuuuucuaaca

SEQ ID NO: 2820 - DNA, 25 bp, Artificial Sequence
  Synthetic oligonucleotide
acccugcaacgauuuuuucuaacag

SEQ ID NO: 2821 - DNA, 25 bp, Artificial Sequence
  Synthetic oligonucleotide
cccugcaacgauuuuuucuaacagg

SEQ ID NO: 2822 - DNA, 25 bp, Artificial Sequence
  Synthetic oligonucleotide
ccugcaacgauuuuuucuaacaggg

SEQ ID NO: 2823 - DNA, 25 bp, Artificial Sequence
  Synthetic oligonucleotide
cugcaacgauuuuuucuaacaggga

SEQ ID NO: 2824 - DNA, 25 bp, Artificial Sequence
  Synthetic oligonucleotide
ugcaacgauuuuuucuaacagggat

SEQ ID NO: 2825 - DNA, 25 bp, Artificial Sequence
  Synthetic oligonucleotide
gcaacgauuuuuucuaacagggata

SEQ ID NO: 2826 - DNA, 25 bp, Artificial Sequence
  Synthetic oligonucleotide
caacgauuuuuucuaacagggauat

SEQ ID NO: 2827 - DNA, 25 bp, Artificial Sequence
  Synthetic oligonucleotide
aacgauuuuuucuaacagggauatt

SEQ ID NO: 2828 - DNA, 25 bp, Artificial Sequence
  Synthetic oligonucleotide
acgauuuuuucuaacagggauauta

SEQ ID NO: 2829 - DNA, 25 bp, Artificial Sequence
  Synthetic oligonucleotide
cgauuuuuucuaacagggauauuat

SEQ ID NO: 2830 - DNA, 25 bp, Artificial Sequence
  Synthetic oligonucleotide
gauuuuuucuaacagggauauuatt

SEQ ID NO: 2831 - DNA, 25 bp, Artificial Sequence
  Synthetic oligonucleotide
auuuuuucuaacagggauauuautg

SEQ ID NO: 2832 - DNA, 25 bp, Artificial Sequence
  Synthetic oligonucleotide
uuuuuucuaacagggauauuauuga

SEQ ID NO: 2833 - DNA, 25 bp, Artificial Sequence
  Synthetic oligonucleotide
uuuuucuaacagggauauuauugac

SEQ ID NO: 2834 - DNA, 25 bp, Artificial Sequence
  Synthetic oligonucleotide
uuuucuaacagggauauuauugact

SEQ ID NO: 2835 - DNA, 25 bp, Artificial Sequence
  Synthetic oligonucleotide
uuucuaacagggauauuauugacta

SEQ ID NO: 2836 - DNA, 25 bp, Artificial Sequence
  Synthetic oligonucleotide
uucuaacagggauauuauugacuaa

SEQ ID NO: 2837 - DNA, 25 bp, Artificial Sequence
  Synthetic oligonucleotide
ucuaacagggauauuauugacuaat

SEQ ID NO: 2838 - DNA, 25 bp, Artificial Sequence
  Synthetic oligonucleotide
cuaacagggauauuauugacuaata

SEQ ID NO: 2839 - DNA, 25 bp, Artificial Sequence
  Synthetic oligonucleotide
uaacagggauauuauugacuaauag

SEQ ID NO: 2840 - DNA, 25 bp, Artificial Sequence
  Synthetic oligonucleotide
aacagggauauuauugacuaauagc

SEQ ID NO: 2841 - DNA, 25 bp, Artificial Sequence
  Synthetic oligonucleotide
acagggauauuauugacuaauagca

SEQ ID NO: 2842 - DNA, 25 bp, Artificial Sequence
  Synthetic oligonucleotide
cagggauauuauugacuaauagcag

SEQ ID NO: 2843 - DNA, 25 bp, Artificial Sequence
  Synthetic oligonucleotide
agggauauuauugacuaauagcaga

SEQ ID NO: 2844 - DNA, 25 bp, Artificial Sequence
  Synthetic oligonucleotide
gggauauuauugacuaauagcagag

SEQ ID NO: 2845 - DNA, 25 bp, Artificial Sequence
  Synthetic oligonucleotide
ggauauuauugacuaauagcagagg

SEQ ID NO: 2846 - DNA, 25 bp, Artificial Sequence
  Synthetic oligonucleotide
gauauuauugacuaauagcagagga

SEQ ID NO: 2847 - DNA, 25 bp, Artificial Sequence
  Synthetic oligonucleotide
auauuauugacuaauagcagaggat

SEQ ID NO: 2848 - DNA, 25 bp, Artificial Sequence
  Synthetic oligonucleotide
uauuauugacuaauagcagaggatg

SEQ ID NO: 2849 - DNA, 25 bp, Artificial Sequence
  Synthetic oligonucleotide
auuauugacuaauagcagaggaugt

SEQ ID NO: 2850 - DNA, 25 bp, Artificial Sequence
  Synthetic oligonucleotide
uuauugacuaauagcagaggaugta

SEQ ID NO: 2851 - DNA, 25 bp, Artificial Sequence
  Synthetic oligonucleotide
uauugacuaauagcagaggauguaa

SEQ ID NO: 2852 - DNA, 25 bp, Artificial Sequence
  Synthetic oligonucleotide
auugacuaauagcagaggauguaat

SEQ ID NO: 2853 - DNA, 25 bp, Artificial Sequence
  Synthetic oligonucleotide
uugacuaauagcagaggauguaata

SEQ ID NO: 2854 - DNA, 25 bp, Artificial Sequence
  Synthetic oligonucleotide
ugacuaauagcagaggauguaauag

SEQ ID NO: 2855 - DNA, 25 bp, Artificial Sequence
  Synthetic oligonucleotide
gacuaauagcagaggauguaauagt

SEQ ID NO: 2856 - DNA, 25 bp, Artificial Sequence
  Synthetic oligonucleotide
acuaauagcagaggauguaauagtc

SEQ ID NO: 2857 - DNA, 25 bp, Artificial Sequence
  Synthetic oligonucleotide
cuaauagcagaggauguaauaguca

SEQ ID NO: 2858 - DNA, 25 bp, Artificial Sequence
  Synthetic oligonucleotide
uaauagcagaggauguaauagucaa

SEQ ID NO: 2859 - DNA, 25 bp, Artificial Sequence
  Synthetic oligonucleotide
aauagcagaggauguaauagucaac

SEQ ID NO: 2860 - DNA, 25 bp, Artificial Sequence
  Synthetic oligonucleotide
auagcagaggauguaauagucaact

SEQ ID NO: 2861 - DNA, 25 bp, Artificial Sequence
  Synthetic oligonucleotide
uagcagaggauguaauagucaactg

SEQ ID NO: 2862 - DNA, 25 bp, Artificial Sequence
  Synthetic oligonucleotide
agcagaggauguaauagucaacuga

SEQ ID NO: 2863 - DNA, 25 bp, Artificial Sequence
  Synthetic oligonucleotide
gcagaggauguaauagucaacugag

SEQ ID NO: 2864 - DNA, 25 bp, Artificial Sequence
  Synthetic oligonucleotide
cagaggauguaauagucaacugagt

SEQ ID NO: 2865 - DNA, 25 bp, Artificial Sequence
  Synthetic oligonucleotide
agaggauguaauagucaacugagtt

SEQ ID NO: 2866 - DNA, 25 bp, Artificial Sequence
  Synthetic oligonucleotide
gaggauguaauagucaacugagutg

SEQ ID NO: 2867 - DNA, 25 bp, Artificial Sequence
  Synthetic oligonucleotide
aggauguaauagucaacugaguugt

SEQ ID NO: 2868 - DNA, 25 bp, Artificial Sequence
  Synthetic oligonucleotide
ggauguaauagucaacugaguugta

SEQ ID NO: 2869 - DNA, 25 bp, Artificial Sequence
  Synthetic oligonucleotide
gauguaauagucaacugaguuguat

SEQ ID NO: 2870 - DNA, 25 bp, Artificial Sequence
  Synthetic oligonucleotide
auguaauagucaacugaguuguatt

SEQ ID NO: 2871 - DNA, 25 bp, Artificial Sequence
  Synthetic oligonucleotide
uguaauagucaacugaguuguautg

SEQ ID NO: 2872 - DNA, 25 bp, Artificial Sequence
  Synthetic oligonucleotide
guaauagucaacugaguuguauugg

SEQ ID NO: 2873 - DNA, 25 bp, Artificial Sequence
  Synthetic oligonucleotide
uaauagucaacugaguuguauuggt

SEQ ID NO: 2874 - DNA, 25 bp, Artificial Sequence
  Synthetic oligonucleotide
aauagucaacugaguuguauuggta

SEQ ID NO: 2875 - DNA, 25 bp, Artificial Sequence
  Synthetic oligonucleotide
auagucaacugaguuguauugguac

SEQ ID NO: 2876 - DNA, 25 bp, Artificial Sequence
  Synthetic oligonucleotide
uagucaacugaguuguauugguacc

SEQ ID NO: 2877 - DNA, 25 bp, Artificial Sequence
  Synthetic oligonucleotide
agucaacugaguuguauugguacca

SEQ ID NO: 2878 - DNA, 25 bp, Artificial Sequence
  Synthetic oligonucleotide
gucaacugaguuguauugguaccac

SEQ ID NO: 2879 - DNA, 25 bp, Artificial Sequence
  Synthetic oligonucleotide
ucaacugaguuguauugguaccact

SEQ ID NO: 2880 - DNA, 25 bp, Artificial Sequence
  Synthetic oligonucleotide
caacugaguuguauugguaccactt

SEQ ID NO: 2881 - DNA, 25 bp, Artificial Sequence
  Synthetic oligonucleotide
aacugaguuguauugguaccacutc

SEQ ID NO: 2882 - DNA, 25 bp, Artificial Sequence
  Synthetic oligonucleotide
acugaguuguauugguaccacuucc

SEQ ID NO: 2883 - DNA, 25 bp, Artificial Sequence
  Synthetic oligonucleotide
cugaguuguauugguaccacuucca

SEQ ID NO: 2884 - DNA, 25 bp, Artificial Sequence
  Synthetic oligonucleotide
ugaguuguauugguaccacuuccat

SEQ ID NO: 2885 - DNA, 25 bp, Artificial Sequence
  Synthetic oligonucleotide
gaguuguauugguaccacuuccatt

SEQ ID NO: 2886 - DNA, 25 bp, Artificial Sequence
  Synthetic oligonucleotide
aguuguauugguaccacuuccautg

SEQ ID NO: 2887 - DNA, 25 bp, Artificial Sequence
  Synthetic oligonucleotide
guuguauugguaccacuuccauugt

SEQ ID NO: 2888 - DNA, 25 bp, Artificial Sequence
  Synthetic oligonucleotide
uuguauugguaccacuuccauugta

SEQ ID NO: 2889 - DNA, 25 bp, Artificial Sequence
  Synthetic oligonucleotide
uguauugguaccacuuccauuguaa

SEQ ID NO: 2890 - DNA, 25 bp, Artificial Sequence
  Synthetic oligonucleotide
guauugguaccacuuccauuguaag

SEQ ID NO: 2891 - DNA, 25 bp, Artificial Sequence
  Synthetic oligonucleotide
uauugguaccacuuccauuguaagt

SEQ ID NO: 2892 - DNA, 25 bp, Artificial Sequence
  Synthetic oligonucleotide
auugguaccacuuccauuguaagtc

SEQ ID NO: 2893 - DNA, 25 bp, Artificial Sequence
  Synthetic oligonucleotide
uugguaccacuuccauuguaagucc

SEQ ID NO: 2894 - DNA, 25 bp, Artificial Sequence
  Synthetic oligonucleotide
ugguaccacuuccauuguaaguccc

SEQ ID NO: 2895 - DNA, 25 bp, Artificial Sequence
  Synthetic oligonucleotide
gguaccacuuccauuguaaguccca

SEQ ID NO: 2896 - DNA, 25 bp, Artificial Sequence
  Synthetic oligonucleotide
guaccacuuccauuguaagucccaa

SEQ ID NO: 2897 - DNA, 25 bp, Artificial Sequence
  Synthetic oligonucleotide
uaccacuuccauuguaagucccaaa

SEQ ID NO: 2898 - DNA, 25 bp, Artificial Sequence
  Synthetic oligonucleotide
accacuuccauuguaagucccaaag

SEQ ID NO: 2899 - DNA, 25 bp, Artificial Sequence
  Synthetic oligonucleotide
ccacuuccauuguaagucccaaagt

SEQ ID NO: 2900 - DNA, 25 bp, Artificial Sequence
  Synthetic oligonucleotide
cacuuccauuguaagucccaaagta

SEQ ID NO: 2901 - DNA, 25 bp, Artificial Sequence
  Synthetic oligonucleotide
acuuccauuguaagucccaaaguat

SEQ ID NO: 2902 - DNA, 25 bp, Artificial Sequence
  Synthetic oligonucleotide
cuuccauuguaagucccaaaguatt

SEQ ID NO: 2903 - DNA, 25 bp, Artificial Sequence
  Synthetic oligonucleotide
uuccauuguaagucccaaaguauta

SEQ ID NO: 2904 - DNA, 25 bp, Artificial Sequence
  Synthetic oligonucleotide
uccauuguaagucccaaaguauuat

SEQ ID NO: 2905 - DNA, 25 bp, Artificial Sequence
  Synthetic oligonucleotide
ccauuguaagucccaaaguauuata

SEQ ID NO: 2906 - DNA, 25 bp, Artificial Sequence
  Synthetic oligonucleotide
cauuguaagucccaaaguauuauat

SEQ ID NO: 2907 - DNA, 25 bp, Artificial Sequence
  Synthetic oligonucleotide
auuguaagucccaaaguauuauata

SEQ ID NO: 2908 - DNA, 25 bp, Artificial Sequence
  Synthetic oligonucleotide
uuguaagucccaaaguauuauauat

SEQ ID NO: 2909 - DNA, 25 bp, Artificial Sequence
  Synthetic oligonucleotide
uguaagucccaaaguauuauauatt

SEQ ID NO: 2910 - DNA, 25 bp, Artificial Sequence
  Synthetic oligonucleotide
guaagucccaaaguauuauauautt

SEQ ID NO: 2911 - DNA, 25 bp, Artificial Sequence
  Synthetic oligonucleotide
uaagucccaaaguauuauauauutg

SEQ ID NO: 2912 - DNA, 25 bp, Artificial Sequence
  Synthetic oligonucleotide
aagucccaaaguauuauauauuuga

SEQ ID NO: 2913 - DNA, 25 bp, Artificial Sequence
  Synthetic oligonucleotide
agucccaaaguauuauauauuugat

SEQ ID NO: 2914 - DNA, 25 bp, Artificial Sequence
  Synthetic oligonucleotide
gucccaaaguauuauauauuugata

SEQ ID NO: 2915 - DNA, 25 bp, Artificial Sequence
  Synthetic oligonucleotide
ucccaaaguauuauauauuugauaa

SEQ ID NO: 2916 - DNA, 25 bp, Artificial Sequence
  Synthetic oligonucleotide
cccaaaguauuauauauuugauaat

SEQ ID NO: 2917 - DNA, 25 bp, Artificial Sequence
  Synthetic oligonucleotide
ccaaaguauuauauauuugauaata

SEQ ID NO: 2918 - DNA, 25 bp, Artificial Sequence
  Synthetic oligonucleotide
caaaguauuauauauuugauaauaa

SEQ ID NO: 2919 - DNA, 25 bp, Artificial Sequence
  Synthetic oligonucleotide
aaaguauuauauauuugauaauaat

SEQ ID NO: 2920 - DNA, 25 bp, Artificial Sequence
  Synthetic oligonucleotide
aaguauuauauauuugauaauaatg

SEQ ID NO: 2921 - DNA, 25 bp, Artificial Sequence
  Synthetic oligonucleotide
aguauuauauauuugauaauaaugc

SEQ ID NO: 2922 - DNA, 25 bp, Artificial Sequence
  Synthetic oligonucleotide
guauuauauauuugauaauaaugct

SEQ ID NO: 2923 - DNA, 25 bp, Artificial Sequence
  Synthetic oligonucleotide
uauuauauauuugauaauaaugcta

SEQ ID NO: 2924 - DNA, 25 bp, Artificial Sequence
  Synthetic oligonucleotide
auuauauauuugauaauaaugcuaa

SEQ ID NO: 2925 - DNA, 25 bp, Artificial Sequence
  Synthetic oligonucleotide
uuauauauuugauaauaaugcuaat

SEQ ID NO: 2926 - DNA, 25 bp, Artificial Sequence
  Synthetic oligonucleotide
uauauauuugauaauaaugcuaatc

SEQ ID NO: 2927 - DNA, 25 bp, Artificial Sequence
  Synthetic oligonucleotide
auauauuugauaauaaugcuaauca

SEQ ID NO: 2928 - DNA, 25 bp, Artificial Sequence
  Synthetic oligonucleotide
uauauuugauaauaaugcuaaucat

SEQ ID NO: 2929 - DNA, 25 bp, Artificial Sequence
  Synthetic oligonucleotide
auauuugauaauaaugcuaaucata

SEQ ID NO: 2930 - DNA, 25 bp, Artificial Sequence
  Synthetic oligonucleotide
uauuugauaauaaugcuaaucauaa

SEQ ID NO: 2931 - DNA, 25 bp, Artificial Sequence
  Synthetic oligonucleotide
auuugauaauaaugcuaaucauaat

SEQ ID NO: 2932 - DNA, 25 bp, Artificial Sequence
  Synthetic oligonucleotide
uuugauaauaaugcuaaucauaatt

SEQ ID NO: 2933 - DNA, 25 bp, Artificial Sequence
  Synthetic oligonucleotide
uugauaauaaugcuaaucauaautg

SEQ ID NO: 2934 - DNA, 25 bp, Artificial Sequence
  Synthetic oligonucleotide
ugauaauaaugcuaaucauaauugg

SEQ ID NO: 2935 - DNA, 25 bp, Artificial Sequence
  Synthetic oligonucleotide
gauaauaaugcuaaucauaauugga

SEQ ID NO: 2936 - DNA, 25 bp, Artificial Sequence
  Synthetic oligonucleotide
auaauaaugcuaaucauaauuggaa

SEQ ID NO: 2937 - DNA, 25 bp, Artificial Sequence
  Synthetic oligonucleotide
uaauaaugcuaaucauaauuggaaa

SEQ ID NO: 2938 - DNA, 25 bp, Artificial Sequence
  Synthetic oligonucleotide
aauaaugcuaaucauaauuggaaag

SEQ ID NO: 2939 - DNA, 25 bp, Artificial Sequence
  Synthetic oligonucleotide
auaaugcuaaucauaauuggaaagt

SEQ ID NO: 2940 - DNA, 25 bp, Artificial Sequence
  Synthetic oligonucleotide
uaaugcuaaucauaauuggaaagta

SEQ ID NO: 2941 - DNA, 25 bp, Artificial Sequence
  Synthetic oligonucleotide
aaugcuaaucauaauuggaaaguaa

SEQ ID NO: 2942 - DNA, 25 bp, Artificial Sequence
  Synthetic oligonucleotide
augcuaaucauaauuggaaaguaac

SEQ ID NO: 2943 - DNA, 25 bp, Artificial Sequence
  Synthetic oligonucleotide
ugcuaaucauaauuggaaaguaaca

SEQ ID NO: 2944 - DNA, 25 bp, Artificial Sequence
  Synthetic oligonucleotide
gcuaaucauaauuggaaaguaacat

SEQ ID NO: 2945 - DNA, 25 bp, Artificial Sequence
  Synthetic oligonucleotide
cuaaucauaauuggaaaguaacatt

SEQ ID NO: 2946 - DNA, 25 bp, Artificial Sequence
  Synthetic oligonucleotide
uaaucauaauuggaaaguaacautc

SEQ ID NO: 2947 - DNA, 25 bp, Artificial Sequence
  Synthetic oligonucleotide
aaucauaauuggaaaguaacauuct

SEQ ID NO: 2948 - DNA, 25 bp, Artificial Sequence
  Synthetic oligonucleotide
aucauaauuggaaaguaacauucta

SEQ ID NO: 2949 - DNA, 25 bp, Artificial Sequence
  Synthetic oligonucleotide
ucauaauuggaaaguaacauucuat

SEQ ID NO: 2950 - DNA, 25 bp, Artificial Sequence
  Synthetic oligonucleotide
cauaauuggaaaguaacauucuata

SEQ ID NO: 2951 - DNA, 25 bp, Artificial Sequence
  Synthetic oligonucleotide
auaauuggaaaguaacauucuauat

SEQ ID NO: 2952 - DNA, 25 bp, Artificial Sequence
  Synthetic oligonucleotide
uaauuggaaaguaacauucuauatg

SEQ ID NO: 2953 - DNA, 25 bp, Artificial Sequence
  Synthetic oligonucleotide
aauuggaaaguaacauucuauaugt

SEQ ID NO: 2954 - DNA, 25 bp, Artificial Sequence
  Synthetic oligonucleotide
auuggaaaguaacauucuauaugta

SEQ ID NO: 2955 - DNA, 25 bp, Artificial Sequence
  Synthetic oligonucleotide
uuggaaaguaacauucuauauguaa

SEQ ID NO: 2956 - DNA, 25 bp, Artificial Sequence
  Synthetic oligonucleotide
uggaaaguaacauucuauauguaaa

SEQ ID NO: 2957 - DNA, 25 bp, Artificial Sequence
  Synthetic oligonucleotide
ggaaaguaacauucuauauguaaat

SEQ ID NO: 2958 - DNA, 25 bp, Artificial Sequence
  Synthetic oligonucleotide
gaaaguaacauucuauauguaaatg

SEQ ID NO: 2959 - DNA, 25 bp, Artificial Sequence
  Synthetic oligonucleotide
aaaguaacauucuauauguaaaugt

SEQ ID NO: 2960 - DNA, 25 bp, Artificial Sequence
  Synthetic oligonucleotide
aaguaacauucuauauguaaaugta

SEQ ID NO: 2961 - DNA, 25 bp, Artificial Sequence
  Synthetic oligonucleotide
aguaacauucuauauguaaauguaa

SEQ ID NO: 2962 - DNA, 25 bp, Artificial Sequence
  Synthetic oligonucleotide
guaacauucuauauguaaauguaaa

SEQ ID NO: 2963 - DNA, 25 bp, Artificial Sequence
  Synthetic oligonucleotide
uaacauucuauauguaaauguaaaa

SEQ ID NO: 2964 - DNA, 25 bp, Artificial Sequence
  Synthetic oligonucleotide
aacauucuauauguaaauguaaaat

SEQ ID NO: 2965 - DNA, 25 bp, Artificial Sequence
  Synthetic oligonucleotide
acauucuauauguaaauguaaaatt

SEQ ID NO: 2966 - DNA, 25 bp, Artificial Sequence
  Synthetic oligonucleotide
cauucuauauguaaauguaaaautt

SEQ ID NO: 2967 - DNA, 25 bp, Artificial Sequence
  Synthetic oligonucleotide
auucuauauguaaauguaaaauuta

SEQ ID NO: 2968 - DNA, 25 bp, Artificial Sequence
  Synthetic oligonucleotide
uucuauauguaaauguaaaauuuat

SEQ ID NO: 2969 - DNA, 25 bp, Artificial Sequence
  Synthetic oligonucleotide
ucuauauguaaauguaaaauuuatt

SEQ ID NO: 2970 - DNA, 25 bp, Artificial Sequence
  Synthetic oligonucleotide
cuauauguaaauguaaaauuuautt

SEQ ID NO: 2971 - DNA, 25 bp, Artificial Sequence
  Synthetic oligonucleotide
uauauguaaauguaaaauuuauutg

SEQ ID NO: 2972 - DNA, 25 bp, Artificial Sequence
  Synthetic oligonucleotide
auauguaaauguaaaauuuauuugc

SEQ ID NO: 2973 - DNA, 25 bp, Artificial Sequence
  Synthetic oligonucleotide
uauguaaauguaaaauuuauuugcc

SEQ ID NO: 2974 - DNA, 25 bp, Artificial Sequence
  Synthetic oligonucleotide
auguaaauguaaaauuuauuugcca

SEQ ID NO: 2975 - DNA, 25 bp, Artificial Sequence
  Synthetic oligonucleotide
uguaaauguaaaauuuauuugccaa

SEQ ID NO: 2976 - DNA, 25 bp, Artificial Sequence
  Synthetic oligonucleotide
guaaauguaaaauuuauuugccaac

SEQ ID NO: 2977 - DNA, 25 bp, Artificial Sequence
  Synthetic oligonucleotide
uaaauguaaaauuuauuugccaact

SEQ ID NO: 2978 - DNA, 25 bp, Artificial Sequence
  Synthetic oligonucleotide
aaauguaaaauuuauuugccaactg

SEQ ID NO: 2979 - DNA, 25 bp, Artificial Sequence
  Synthetic oligonucleotide
aauguaaaauuuauuugccaacuga

SEQ ID NO: 2980 - DNA, 25 bp, Artificial Sequence
  Synthetic oligonucleotide
auguaaaauuuauuugccaacugaa

SEQ ID NO: 2981 - DNA, 25 bp, Artificial Sequence
  Synthetic oligonucleotide
uguaaaauuuauuugccaacugaat

SEQ ID NO: 2982 - DNA, 25 bp, Artificial Sequence
  Synthetic oligonucleotide
guaaaauuuauuugccaacugaata

SEQ ID NO: 2983 - DNA, 25 bp, Artificial Sequence
  Synthetic oligonucleotide
uaaaauuuauuugccaacugaauat

SEQ ID NO: 2984 - DNA, 25 bp, Artificial Sequence
  Synthetic oligonucleotide
aaaauuuauuugccaacugaauata

SEQ ID NO: 2985 - DNA, 25 bp, Artificial Sequence
  Synthetic oligonucleotide
aaauuuauuugccaacugaauauag

SEQ ID NO: 2986 - DNA, 25 bp, Artificial Sequence
  Synthetic oligonucleotide
aauuuauuugccaacugaauauagg

SEQ ID NO: 2987 - DNA, 25 bp, Artificial Sequence
  Synthetic oligonucleotide
auuuauuugccaacugaauauaggc

SEQ ID NO: 2988 - DNA, 25 bp, Artificial Sequence
  Synthetic oligonucleotide
uuuauuugccaacugaauauaggca

SEQ ID NO: 2989 - DNA, 25 bp, Artificial Sequence
  Synthetic oligonucleotide
uuauuugccaacugaauauaggcaa

SEQ ID NO: 2990 - DNA, 25 bp, Artificial Sequence
  Synthetic oligonucleotide
uauuugccaacugaauauaggcaat

SEQ ID NO: 2991 - DNA, 25 bp, Artificial Sequence
  Synthetic oligonucleotide
auuugccaacugaauauaggcaatg

SEQ ID NO: 2992 - DNA, 25 bp, Artificial Sequence
  Synthetic oligonucleotide
uuugccaacugaauauaggcaauga

SEQ ID NO: 2993 - DNA, 25 bp, Artificial Sequence
  Synthetic oligonucleotide
uugccaacugaauauaggcaaugat

SEQ ID NO: 2994 - DNA, 25 bp, Artificial Sequence
  Synthetic oligonucleotide
ugccaacugaauauaggcaaugata

SEQ ID NO: 2995 - DNA, 25 bp, Artificial Sequence
  Synthetic oligonucleotide
gccaacugaauauaggcaaugauag

SEQ ID NO: 2996 - DNA, 25 bp, Artificial Sequence
  Synthetic oligonucleotide
ccaacugaauauaggcaaugauagt

SEQ ID NO: 2997 - DNA, 25 bp, Artificial Sequence
  Synthetic oligonucleotide
caacugaauauaggcaaugauagtg

SEQ ID NO: 2998 - DNA, 25 bp, Artificial Sequence
  Synthetic oligonucleotide
aacugaauauaggcaaugauagugt

SEQ ID NO: 2999 - DNA, 25 bp, Artificial Sequence
  Synthetic oligonucleotide
acugaauauaggcaaugauagugtg

SEQ ID NO: 3000 - DNA, 25 bp, Artificial Sequence
  Synthetic oligonucleotide
cugaauauaggcaaugauagugugt

SEQ ID NO: 3001 - DNA, 25 bp, Artificial Sequence
  Synthetic oligonucleotide
ugaauauaggcaaugauagugugtc

SEQ ID NO: 3002 - DNA, 25 bp, Artificial Sequence
  Synthetic oligonucleotide
gaauauaggcaaugauaguguguca

SEQ ID NO: 3003 - DNA, 25 bp, Artificial Sequence
  Synthetic oligonucleotide
aauauaggcaaugauagugugucac

SEQ ID NO: 3004 - DNA, 25 bp, Artificial Sequence
  Synthetic oligonucleotide
auauaggcaaugauagugugucact

SEQ ID NO: 3005 - DNA, 25 bp, Artificial Sequence
  Synthetic oligonucleotide
uauaggcaaugauagugugucacta

SEQ ID NO: 3006 - DNA, 25 bp, Artificial Sequence
  Synthetic oligonucleotide
auaggcaaugauagugugucacuat

SEQ ID NO: 3007 - DNA, 25 bp, Artificial Sequence
  Synthetic oligonucleotide
uaggcaaugauagugugucacuata

SEQ ID NO: 3008 - DNA, 25 bp, Artificial Sequence
  Synthetic oligonucleotide
aggcaaugauagugugucacuauag

SEQ ID NO: 3009 - DNA, 25 bp, Artificial Sequence
  Synthetic oligonucleotide
ggcaaugauagugugucacuauagg

SEQ ID NO: 3010 - DNA, 25 bp, Artificial Sequence
  Synthetic oligonucleotide
gcaaugauagugugucacuauaggg

SEQ ID NO: 3011 - DNA, 25 bp, Artificial Sequence
  Synthetic oligonucleotide
caaugauagugugucacuauaggga

SEQ ID NO: 3012 - DNA, 25 bp, Artificial Sequence
  Synthetic oligonucleotide
aaugauagugugucacuauagggaa

SEQ ID NO: 3013 - DNA, 25 bp, Artificial Sequence
  Synthetic oligonucleotide
augauagugugucacuauagggaac

SEQ ID NO: 3014 - DNA, 25 bp, Artificial Sequence
  Synthetic oligonucleotide
ugauagugugucacuauagggaaca

SEQ ID NO: 3015 - DNA, 25 bp, Artificial Sequence
  Synthetic oligonucleotide
gauagugugucacuauagggaacac

SEQ ID NO: 3016 - DNA, 25 bp, Artificial Sequence
  Synthetic oligonucleotide
auagugugucacuauagggaacaca

SEQ ID NO: 3017 - DNA, 25 bp, Artificial Sequence
  Synthetic oligonucleotide
uagugugucacuauagggaacacag

SEQ ID NO: 3018 - DNA, 25 bp, Artificial Sequence
  Synthetic oligonucleotide
agugugucacuauagggaacacaga

SEQ ID NO: 3019 - DNA, 25 bp, Artificial Sequence
  Synthetic oligonucleotide
gugugucacuauagggaacacagat

SEQ ID NO: 3020 - DNA, 25 bp, Artificial Sequence
  Synthetic oligonucleotide
ugugucacuauagggaacacagatt

SEQ ID NO: 3021 - DNA, 25 bp, Artificial Sequence
  Synthetic oligonucleotide
gugucacuauagggaacacagautt

SEQ ID NO: 3022 - DNA, 25 bp, Artificial Sequence
  Synthetic oligonucleotide
ugucacuauagggaacacagauutt

SEQ ID NO: 3023 - DNA, 25 bp, Artificial Sequence
  Synthetic oligonucleotide
gucacuauagggaacacagauuutt

SEQ ID NO: 3024 - DNA, 25 bp, Artificial Sequence
  Synthetic oligonucleotide
ucacuauagggaacacagauuuutg

SEQ ID NO: 3025 - DNA, 25 bp, Artificial Sequence
  Synthetic oligonucleotide
cacuauagggaacacagauuuuuga

SEQ ID NO: 3026 - DNA, 25 bp, Artificial Sequence
  Synthetic oligonucleotide
acuauagggaacacagauuuuugag

SEQ ID NO: 3027 - DNA, 25 bp, Artificial Sequence
  Synthetic oligonucleotide
cuauagggaacacagauuuuugaga

SEQ ID NO: 3028 - DNA, 25 bp, Artificial Sequence
  Synthetic oligonucleotide
uauagggaacacagauuuuugagat

SEQ ID NO: 3029 - DNA, 25 bp, Artificial Sequence
  Synthetic oligonucleotide
auagggaacacagauuuuugagatc

SEQ ID NO: 3030 - DNA, 25 bp, Artificial Sequence
  Synthetic oligonucleotide
uagggaacacagauuuuugagauct

SEQ ID NO: 3031 - DNA, 25 bp, Artificial Sequence
  Synthetic oligonucleotide
agggaacacagauuuuugagauctt

SEQ ID NO: 3032 - DNA, 25 bp, Artificial Sequence
  Synthetic oligonucleotide
gggaacacagauuuuugagaucutg

SEQ ID NO: 3033 - DNA, 25 bp, Artificial Sequence
  Synthetic oligonucleotide
ggaacacagauuuuugagaucuugt

SEQ ID NO: 3034 - DNA, 25 bp, Artificial Sequence
  Synthetic oligonucleotide
gaacacagauuuuugagaucuugtc

SEQ ID NO: 3035 - DNA, 25 bp, Artificial Sequence
  Synthetic oligonucleotide
aacacagauuuuugagaucuugucc

SEQ ID NO: 3036 - DNA, 25 bp, Artificial Sequence
  Synthetic oligonucleotide
acacagauuuuugagaucuugucct

SEQ ID NO: 3037 - DNA, 25 bp, Artificial Sequence
  Synthetic oligonucleotide
cacagauuuuugagaucuugucctc

SEQ ID NO: 3038 - DNA, 25 bp, Artificial Sequence
  Synthetic oligonucleotide
acagauuuuugagaucuuguccuct

SEQ ID NO: 3039 - DNA, 25 bp, Artificial Sequence
  Synthetic oligonucleotide
cagauuuuugagaucuuguccuctg

SEQ ID NO: 3040 - DNA, 25 bp, Artificial Sequence
  Synthetic oligonucleotide
agauuuuugagaucuuguccucugg

SEQ ID NO: 3041 - DNA, 25 bp, Artificial Sequence
  Synthetic oligonucleotide
gauuuuugagaucuuguccucugga

SEQ ID NO: 3042 - DNA, 25 bp, Artificial Sequence
  Synthetic oligonucleotide
auuuuugagaucuuguccucuggaa

SEQ ID NO: 3043 - DNA, 25 bp, Artificial Sequence
  Synthetic oligonucleotide
uuuuugagaucuuguccucuggaag

SEQ ID NO: 3044 - DNA, 25 bp, Artificial Sequence
  Synthetic oligonucleotide
uuuugagaucuuguccucuggaagc

SEQ ID NO: 3045 - DNA, 25 bp, Artificial Sequence
  Synthetic oligonucleotide
uuugagaucuuguccucuggaagct

SEQ ID NO: 3046 - DNA, 25 bp, Artificial Sequence
  Synthetic oligonucleotide
uugagaucuuguccucuggaagctg

SEQ ID NO: 3047 - DNA, 25 bp, Artificial Sequence
  Synthetic oligonucleotide
ugagaucuuguccucuggaagcugg

SEQ ID NO: 3048 - DNA, 25 bp, Artificial Sequence
  Synthetic oligonucleotide
gagaucuuguccucuggaagcuggt

SEQ ID NO: 3049 - DNA, 25 bp, Artificial Sequence
  Synthetic oligonucleotide
agaucuuguccucuggaagcuggta

SEQ ID NO: 3050 - DNA, 25 bp, Artificial Sequence
  Synthetic oligonucleotide
gaucuuguccucuggaagcugguaa

SEQ ID NO: 3051 - DNA, 25 bp, Artificial Sequence
  Synthetic oligonucleotide
aucuuguccucuggaagcugguaac

SEQ ID NO: 3052 - DNA, 25 bp, Artificial Sequence
  Synthetic oligonucleotide
ucuuguccucuggaagcugguaaca

SEQ ID NO: 3053 - DNA, 25 bp, Artificial Sequence
  Synthetic oligonucleotide
cuuguccucuggaagcugguaacaa

SEQ ID NO: 3054 - DNA, 25 bp, Artificial Sequence
  Synthetic oligonucleotide
uuguccucuggaagcugguaacaat

SEQ ID NO: 3055 - DNA, 25 bp, Artificial Sequence
  Synthetic oligonucleotide
uguccucuggaagcugguaacaatt

SEQ ID NO: 3056 - DNA, 25 bp, Artificial Sequence
  Synthetic oligonucleotide
guccucuggaagcugguaacaauta

SEQ ID NO: 3057 - DNA, 25 bp, Artificial Sequence
  Synthetic oligonucleotide
uccucuggaagcugguaacaauuaa

SEQ ID NO: 3058 - DNA, 25 bp, Artificial Sequence
  Synthetic oligonucleotide
ccucuggaagcugguaacaauuaaa

SEQ ID NO: 3059 - DNA, 25 bp, Artificial Sequence
  Synthetic oligonucleotide
cucuggaagcugguaacaauuaaaa

SEQ ID NO: 3060 - DNA, 25 bp, Artificial Sequence
  Synthetic oligonucleotide
ucuggaagcugguaacaauuaaaaa

SEQ ID NO: 3061 - DNA, 25 bp, Artificial Sequence
  Synthetic oligonucleotide
cuggaagcugguaacaauuaaaaac

SEQ ID NO: 3062 - DNA, 25 bp, Artificial Sequence
  Synthetic oligonucleotide
uggaagcugguaacaauuaaaaaca

SEQ ID NO: 3063 - DNA, 25 bp, Artificial Sequence
  Synthetic oligonucleotide
ggaagcugguaacaauuaaaaacaa

SEQ ID NO: 3064 - DNA, 25 bp, Artificial Sequence
  Synthetic oligonucleotide
gaagcugguaacaauuaaaaacaat

SEQ ID NO: 3065 - DNA, 25 bp, Artificial Sequence
  Synthetic oligonucleotide
aagcugguaacaauuaaaaacaatc

SEQ ID NO: 3066 - DNA, 25 bp, Artificial Sequence
  Synthetic oligonucleotide
agcugguaacaauuaaaaacaauct

SEQ ID NO: 3067 - DNA, 25 bp, Artificial Sequence
  Synthetic oligonucleotide
gcugguaacaauuaaaaacaauctt

SEQ ID NO: 3068 - DNA, 25 bp, Artificial Sequence
  Synthetic oligonucleotide
cugguaacaauuaaaaacaaucuta

SEQ ID NO: 3069 - DNA, 25 bp, Artificial Sequence
  Synthetic oligonucleotide
ugguaacaauuaaaaacaaucuuaa

SEQ ID NO: 3070 - DNA, 25 bp, Artificial Sequence
  Synthetic oligonucleotide
gguaacaauuaaaaacaaucuuaag

SEQ ID NO: 3071 - DNA, 25 bp, Artificial Sequence
  Synthetic oligonucleotide
guaacaauuaaaaacaaucuuaagg

SEQ ID NO: 3072 - DNA, 25 bp, Artificial Sequence
  Synthetic oligonucleotide
uaacaauuaaaaacaaucuuaaggc

SEQ ID NO: 3073 - DNA, 25 bp, Artificial Sequence
  Synthetic oligonucleotide
aacaauuaaaaacaaucuuaaggca

SEQ ID NO: 3074 - DNA, 25 bp, Artificial Sequence
  Synthetic oligonucleotide
acaauuaaaaacaaucuuaaggcag

SEQ ID NO: 3075 - DNA, 25 bp, Artificial Sequence
  Synthetic oligonucleotide
caauuaaaaacaaucuuaaggcagg

SEQ ID NO: 3076 - DNA, 25 bp, Artificial Sequence
  Synthetic oligonucleotide
aauuaaaaacaaucuuaaggcaggg

SEQ ID NO: 3077 - DNA, 25 bp, Artificial Sequence
  Synthetic oligonucleotide
auuaaaaacaaucuuaaggcaggga

SEQ ID NO: 3078 - DNA, 25 bp, Artificial Sequence
  Synthetic oligonucleotide
uuaaaaacaaucuuaaggcagggaa

SEQ ID NO: 3079 - DNA, 25 bp, Artificial Sequence
  Synthetic oligonucleotide
uaaaaacaaucuuaaggcagggaaa

SEQ ID NO: 3080 - DNA, 25 bp, Artificial Sequence
  Synthetic oligonucleotide
aaaaacaaucuuaaggcagggaaaa

SEQ ID NO: 3081 - DNA, 25 bp, Artificial Sequence
  Synthetic oligonucleotide
aaaacaaucuuaaggcagggaaaaa

SEQ ID NO: 3082 - DNA, 25 bp, Artificial Sequence
  Synthetic oligonucleotide
aaacaaucuuaaggcagggaaaaaa

SEQ ID NO: 3083 - DNA, 25 bp, Artificial Sequence
  Synthetic oligonucleotide
aacaaucuuaaggcagggaaaaaaa

SEQ ID NO: 3084 - DNA, 25 bp, Artificial Sequence
  Synthetic oligonucleotide
acaaucuuaaggcagggaaaaaaaa

SEQ ID NO: 3085 - DNA, 25 bp, Artificial Sequence
  Synthetic oligonucleotide
caaucuuaaggcagggaaaaaaaaa

SEQ ID NO: 3086 - DNA, 25 bp, Artificial Sequence
  Synthetic oligonucleotide
aaucuuaaggcagggaaaaaaaaaa

SEQ ID NO: 3087 - DNA, 25 bp, Artificial Sequence
  Synthetic oligonucleotide
aucuuaaggcagggaaaaaaaaaaa

SEQ ID NO: 3088 - DNA, 25 bp, Artificial Sequence
  Synthetic oligonucleotide
ucuuaaggcagggaaaaaaaaaaaa

SEQ ID NO: 3089 - DNA, 25 bp, Artificial Sequence
  Synthetic oligonucleotide
cuuaaggcagggaaaaaaaaaaaaa

SEQ ID NO: 3090 - DNA, 25 bp, Artificial Sequence
  Synthetic oligonucleotide
uuaaggcagggaaaaaaaaaaaaaa

SEQ ID NO: 3091 - DNA, 25 bp, Artificial Sequence
  Synthetic oligonucleotide
uaaggcagggaaaaaaaaaaaaaaa

SEQ ID NO: 3092 - DNA, 25 bp, Artificial Sequence
  Synthetic oligonucleotide
aaggcagggaaaaaaaaaaaaaaaa

SEQ ID NO: 3093 - DNA, 25 bp, Artificial Sequence
  Synthetic oligonucleotide
aggcagggaaaaaaaaaaaaaaaaa

SEQ ID NO: 3094 - DNA, 25 bp, Artificial Sequence
  Synthetic oligonucleotide
ggcagggaaaaaaaaaaaaaaaaaa

SEQ ID NO: 3095 - RNA, 27 nt, Artificial Sequence
  Synthetic oligonucleotide
gcgcagccagacaaccgaccggcagac

SEQ ID NO: 3096 - RNA, 27 nt, Artificial Sequence
  Synthetic oligonucleotide
cgcgcagccagacaaccgaccggcaga

SEQ ID NO: 3097 - RNA, 27 nt, Artificial Sequence
  Synthetic oligonucleotide
gcgcgcagccagacaaccgaccggcag

SEQ ID NO: 3098 - RNA, 27 nt, Artificial Sequence
  Synthetic oligonucleotide
uggcgcgcgcagccagacaaccgaccg

SEQ ID NO: 3099 - RNA, 27 nt, Artificial Sequence
  Synthetic oligonucleotide
guggaugccgagccaggcggggcacug

SEQ ID NO: 3100 - RNA, 27 nt, Artificial Sequence
  Synthetic oligonucleotide
uggggguggaugccgagccaggcgggg

SEQ ID NO: 3101 - RNA, 27 nt, Artificial Sequence
  Synthetic oligonucleotide
cuggggguggaugccgagccaggcggg

SEQ ID NO: 3102 - RNA, 27 nt, Artificial Sequence
  Synthetic oligonucleotide
ggcuggggguggaugccgagccaggcg

SEQ ID NO: 3103 - RNA, 27 nt, Artificial Sequence
  Synthetic oligonucleotide
cgggcuggggguggaugccgagccagg

SEQ ID NO: 3104 - RNA, 27 nt, Artificial Sequence
  Synthetic oligonucleotide
ucgggcuggggguggaugccgagccag

SEQ ID NO: 3105 - RNA, 27 nt, Artificial Sequence
  Synthetic oligonucleotide
gucgggcuggggguggaugccgagcca

SEQ ID NO: 3106 - RNA, 27 nt, Artificial Sequence
  Synthetic oligonucleotide
agucgggcuggggguggaugccgagcc

SEQ ID NO: 3107 - RNA, 27 nt, Artificial Sequence
  Synthetic oligonucleotide
gagucgggcuggggguggaugccgagc

SEQ ID NO: 3108 - RNA, 27 nt, Artificial Sequence
  Synthetic oligonucleotide
ugagucgggcuggggguggaugccgag

SEQ ID NO: 3109 - RNA, 27 nt, Artificial Sequence
  Synthetic oligonucleotide
gugagucgggcuggggguggaugccga

SEQ ID NO: 3110 - RNA, 27 nt, Artificial Sequence
  Synthetic oligonucleotide
ugugagucgggcuggggguggaugccg

SEQ ID NO: 3111 - RNA, 27 nt, Artificial Sequence
  Synthetic oligonucleotide
gugugagucgggcuggggguggaugcc

SEQ ID NO: 3112 - RNA, 27 nt, Artificial Sequence
  Synthetic oligonucleotide
cgugugagucgggcuggggguggaugc

SEQ ID NO: 3113 - RNA, 27 nt, Artificial Sequence
  Synthetic oligonucleotide
acgugugagucgggcuggggguggaug

SEQ ID NO: 3114 - RNA, 27 nt, Artificial Sequence
  Synthetic oligonucleotide
cacgugugagucgggcuggggguggau

SEQ ID NO: 3115 - RNA, 27 nt, Artificial Sequence
  Synthetic oligonucleotide
ccacgugugagucgggcugggggugga

SEQ ID NO: 3116 - RNA, 27 nt, Artificial Sequence
  Synthetic oligonucleotide
cccacgugugagucgggcugggggugg

SEQ ID NO: 3117 - RNA, 27 nt, Artificial Sequence
  Synthetic oligonucleotide
acccacgugugagucgggcugggggug

SEQ ID NO: 3118 - RNA, 27 nt, Artificial Sequence
  Synthetic oligonucleotide
aacccacgugugagucgggcugggggu

SEQ ID NO: 3119 - RNA, 27 nt, Artificial Sequence
  Synthetic oligonucleotide
gaacccacgugugagucgggcuggggg

SEQ ID NO: 3120 - RNA, 27 nt, Artificial Sequence
  Synthetic oligonucleotide
ggaacccacgugugagucgggcugggg

SEQ ID NO: 3121 - RNA, 27 nt, Artificial Sequence
  Synthetic oligonucleotide
gggaacccacgugugagucgggcuggg

SEQ ID NO: 3122 - RNA, 27 nt, Artificial Sequence
  Synthetic oligonucleotide
cgggaacccacgugugagucgggcugg

SEQ ID NO: 3123 - RNA, 27 nt, Artificial Sequence
  Synthetic oligonucleotide
gcgggaacccacgugugagucgggcug

SEQ ID NO: 3124 - RNA, 27 nt, Artificial Sequence
  Synthetic oligonucleotide
ugcgggaacccacgugugagucgggcu

SEQ ID NO: 3125 - RNA, 27 nt, Artificial Sequence
  Synthetic oligonucleotide
gugcgggaacccacgugugagucgggc

SEQ ID NO: 3126 - RNA, 27 nt, Artificial Sequence
  Synthetic oligonucleotide
cgugcgggaacccacgugugagucggg

SEQ ID NO: 3127 - RNA, 27 nt, Artificial Sequence
  Synthetic oligonucleotide
acgugcgggaacccacgugugagucgg

SEQ ID NO: 3128 - RNA, 27 nt, Artificial Sequence
  Synthetic oligonucleotide
gacgugcgggaacccacgugugagucg

SEQ ID NO: 3129 - RNA, 27 nt, Artificial Sequence
  Synthetic oligonucleotide
ggacgugcgggaacccacgugugaguc

SEQ ID NO: 3130 - RNA, 27 nt, Artificial Sequence
  Synthetic oligonucleotide
cggacgugcgggaacccacgugugagu

SEQ ID NO: 3131 - RNA, 27 nt, Artificial Sequence
  Synthetic oligonucleotide
gcggacgugcgggaacccacgugugag

SEQ ID NO: 3132 - RNA, 27 nt, Artificial Sequence
  Synthetic oligonucleotide
ggcggacgugcgggaacccacguguga

SEQ ID NO: 3133 - RNA, 27 nt, Artificial Sequence
  Synthetic oligonucleotide
cggcggacgugcgggaacccacgugug

SEQ ID NO: 3134 - RNA, 27 nt, Artificial Sequence
  Synthetic oligonucleotide
augcugacgucagcggggggggccggc

SEQ ID NO: 3135 - RNA, 27 nt, Artificial Sequence
  Synthetic oligonucleotide
uaugcugacgucagcggggggggccgg

SEQ ID NO: 3136 - RNA, 27 nt, Artificial Sequence
  Synthetic oligonucleotide
cuaugcugacgucagcggggggggccg

SEQ ID NO: 3137 - RNA, 27 nt, Artificial Sequence
  Synthetic oligonucleotide
gcuaugcugacgucagcggggggggcc

SEQ ID NO: 3138 - RNA, 27 nt, Artificial Sequence
  Synthetic oligonucleotide
agcuaugcugacgucagcggggggggc

SEQ ID NO: 3139 - RNA, 27 nt, Artificial Sequence
  Synthetic oligonucleotide
cagcuaugcugacgucagcgggggggg

SEQ ID NO: 3140 - RNA, 27 nt, Artificial Sequence
  Synthetic oligonucleotide
acagcuaugcugacgucagcggggggg

SEQ ID NO: 3141 - RNA, 27 nt, Artificial Sequence
  Synthetic oligonucleotide
aacagcuaugcugacgucagcgggggg

SEQ ID NO: 3142 - RNA, 27 nt, Artificial Sequence
  Synthetic oligonucleotide
gaacagcuaugcugacgucagcggggg

SEQ ID NO: 3143 - RNA, 27 nt, Artificial Sequence
  Synthetic oligonucleotide
ggaacagcuaugcugacgucagcgggg

SEQ ID NO: 3144 - RNA, 27 nt, Artificial Sequence
  Synthetic oligonucleotide
uggaacagcuaugcugacgucagcggg

SEQ ID NO: 3145 - RNA, 27 nt, Artificial Sequence
  Synthetic oligonucleotide
guggaacagcuaugcugacgucagcgg

SEQ ID NO: 3146 - RNA, 27 nt, Artificial Sequence
  Synthetic oligonucleotide
aguggaacagcuaugcugacgucagcg

SEQ ID NO: 3147 - RNA, 27 nt, Artificial Sequence
  Synthetic oligonucleotide
aaguggaacagcuaugcugacgucagc

SEQ ID NO: 3148 - RNA, 27 nt, Artificial Sequence
  Synthetic oligonucleotide
uaaguggaacagcuaugcugacgucag

SEQ ID NO: 3149 - RNA, 27 nt, Artificial Sequence
  Synthetic oligonucleotide
uuaaguggaacagcuaugcugacguca

SEQ ID NO: 3150 - RNA, 27 nt, Artificial Sequence
  Synthetic oligonucleotide
cuuaaguggaacagcuaugcugacguc

SEQ ID NO: 3151 - RNA, 27 nt, Artificial Sequence
  Synthetic oligonucleotide
ccuuaaguggaacagcuaugcugacgu

SEQ ID NO: 3152 - RNA, 27 nt, Artificial Sequence
  Synthetic oligonucleotide
gccuuaaguggaacagcuaugcugacg

SEQ ID NO: 3153 - RNA, 27 nt, Artificial Sequence
  Synthetic oligonucleotide
ggccuuaaguggaacagcuaugcugac

SEQ ID NO: 3154 - RNA, 27 nt, Artificial Sequence
  Synthetic oligonucleotide
gggccuuaaguggaacagcuaugcuga

SEQ ID NO: 3155 - RNA, 27 nt, Artificial Sequence
  Synthetic oligonucleotide
ggggccuuaaguggaacagcuaugcug

SEQ ID NO: 3156 - RNA, 27 nt, Artificial Sequence
  Synthetic oligonucleotide
aggggccuuaaguggaacagcuaugcu

SEQ ID NO: 3157 - RNA, 27 nt, Artificial Sequence
  Synthetic oligonucleotide
gaggggccuuaaguggaacagcuaugc

SEQ ID NO: 3158 - RNA, 27 nt, Artificial Sequence
  Synthetic oligonucleotide
ggaggggccuuaaguggaacagcuaug

SEQ ID NO: 3159 - RNA, 27 nt, Artificial Sequence
  Synthetic oligonucleotide
gggaggggccuuaaguggaacagcuau

SEQ ID NO: 3160 - RNA, 27 nt, Artificial Sequence
  Synthetic oligonucleotide
cgggaggggccuuaaguggaacagcua

SEQ ID NO: 3161 - RNA, 27 nt, Artificial Sequence
  Synthetic oligonucleotide
gcgggaggggccuuaaguggaacagcu

SEQ ID NO: 3162 - RNA, 27 nt, Artificial Sequence
  Synthetic oligonucleotide
agcacucugagcugggcgcgggagggg

SEQ ID NO: 3163 - RNA, 27 nt, Artificial Sequence
  Synthetic oligonucleotide
ugcagcacucugagcugggcgcgggag

SEQ ID NO: 3164 - RNA, 27 nt, Artificial Sequence
  Synthetic oligonucleotide
cugcagcacucugagcugggcgcggga

SEQ ID NO: 3165 - RNA, 27 nt, Artificial Sequence
  Synthetic oligonucleotide
gcugcagcacucugagcugggcgcggg

SEQ ID NO: 3166 - RNA, 27 nt, Artificial Sequence
  Synthetic oligonucleotide
ggcugcagcacucugagcugggcgcgg

SEQ ID NO: 3167 - RNA, 27 nt, Artificial Sequence
  Synthetic oligonucleotide
gcggcugcagcacucugagcugggcgc

SEQ ID NO: 3168 - RNA, 27 nt, Artificial Sequence
  Synthetic oligonucleotide
agcggcugcagcacucugagcugggcg

SEQ ID NO: 3169 - RNA, 27 nt, Artificial Sequence
  Synthetic oligonucleotide
gcagcggcugcagcacucugagcuggg

SEQ ID NO: 3170 - RNA, 27 nt, Artificial Sequence
  Synthetic oligonucleotide
ggcagcggcugcagcacucugagcugg

SEQ ID NO: 3171 - RNA, 27 nt, Artificial Sequence
  Synthetic oligonucleotide
cggcagcggcugcagcacucugagcug

SEQ ID NO: 3172 - RNA, 27 nt, Artificial Sequence
  Synthetic oligonucleotide
gcggcagcggcugcagcacucugagcu

SEQ ID NO: 3173 - RNA, 27 nt, Artificial Sequence
  Synthetic oligonucleotide
ugagauccggaaucggcggcagcggcu

SEQ ID NO: 3174 - RNA, 27 nt, Artificial Sequence
  Synthetic oligonucleotide
augagauccggaaucggcggcagcggc

SEQ ID NO: 3175 - RNA, 27 nt, Artificial Sequence
  Synthetic oligonucleotide
aaugagauccggaaucggcggcagcgg

SEQ ID NO: 3176 - RNA, 27 nt, Artificial Sequence
  Synthetic oligonucleotide
caaugagauccggaaucggcggcagcg

SEQ ID NO: 3177 - RNA, 27 nt, Artificial Sequence
  Synthetic oligonucleotide
gcaaugagauccggaaucggcggcagc

SEQ ID NO: 3178 - RNA, 27 nt, Artificial Sequence
  Synthetic oligonucleotide
ggcaaugagauccggaaucggcggcag

SEQ ID NO: 3179 - RNA, 27 nt, Artificial Sequence
  Synthetic oligonucleotide
uggcaaugagauccggaaucggcggca

SEQ ID NO: 3180 - RNA, 27 nt, Artificial Sequence
  Synthetic oligonucleotide
guggcaaugagauccggaaucggcggc

SEQ ID NO: 3181 - RNA, 27 nt, Artificial Sequence
  Synthetic oligonucleotide
cguggcaaugagauccggaaucggcgg

SEQ ID NO: 3182 - RNA, 27 nt, Artificial Sequence
  Synthetic oligonucleotide
gcguggcaaugagauccggaaucggcg

SEQ ID NO: 3183 - RNA, 27 nt, Artificial Sequence
  Synthetic oligonucleotide
cgcguggcaaugagauccggaaucggc

SEQ ID NO: 3184 - RNA, 27 nt, Artificial Sequence
  Synthetic oligonucleotide
gcgcguggcaaugagauccggaaucgg

SEQ ID NO: 3185 - RNA, 27 nt, Artificial Sequence
  Synthetic oligonucleotide
ggcgcguggcaaugagauccggaaucg

SEQ ID NO: 3186 - RNA, 27 nt, Artificial Sequence
  Synthetic oligonucleotide
gggcgcguggcaaugagauccggaauc

SEQ ID NO: 3187 - RNA, 27 nt, Artificial Sequence
  Synthetic oligonucleotide
ggggcgcguggcaaugagauccggaau

SEQ ID NO: 3188 - RNA, 27 nt, Artificial Sequence
  Synthetic oligonucleotide
gggggcgcguggcaaugagauccggaa

SEQ ID NO: 3189 - RNA, 27 nt, Artificial Sequence
  Synthetic oligonucleotide
cgggggcgcguggcaaugagauccgga

SEQ ID NO: 3190 - RNA, 27 nt, Artificial Sequence
  Synthetic oligonucleotide
ucgggggcgcguggcaaugagauccgg

SEQ ID NO: 3191 - RNA, 27 nt, Artificial Sequence
  Synthetic oligonucleotide
gucgggggcgcguggcaaugagauccg

SEQ ID NO: 3192 - RNA, 27 nt, Artificial Sequence
  Synthetic oligonucleotide
cgucgggggcgcguggcaaugagaucc

SEQ ID NO: 3193 - RNA, 27 nt, Artificial Sequence
  Synthetic oligonucleotide
ucgucgggggcgcguggcaaugagauc

SEQ ID NO: 3194 - RNA, 27 nt, Artificial Sequence
  Synthetic oligonucleotide
gucgucgggggcgcguggcaaugagau

SEQ ID NO: 3195 - RNA, 27 nt, Artificial Sequence
  Synthetic oligonucleotide
ggucgucgggggcgcguggcaaugaga

SEQ ID NO: 3196 - RNA, 27 nt, Artificial Sequence
  Synthetic oligonucleotide
cggucgucgggggcgcguggcaaugag

SEQ ID NO: 3197 - RNA, 27 nt, Artificial Sequence
  Synthetic oligonucleotide
gcggucgucgggggcgcguggcaauga

SEQ ID NO: 3198 - RNA, 27 nt, Artificial Sequence
  Synthetic oligonucleotide
aaugcacgucgggcggucgucgggggc

SEQ ID NO: 3199 - RNA, 27 nt, Artificial Sequence
  Synthetic oligonucleotide
gaaugcacgucgggcggucgucggggg

SEQ ID NO: 3200 - RNA, 27 nt, Artificial Sequence
  Synthetic oligonucleotide
ggaaugcacgucgggcggucgucgggg

SEQ ID NO: 3201 - RNA, 27 nt, Artificial Sequence
  Synthetic oligonucleotide
gggaaugcacgucgggcggucgucggg

SEQ ID NO: 3202 - RNA, 27 nt, Artificial Sequence
  Synthetic oligonucleotide
cgggaaugcacgucgggcggucgucgg

SEQ ID NO: 3203 - RNA, 27 nt, Artificial Sequence
  Synthetic oligonucleotide
ucgggaaugcacgucgggcggucgucg

SEQ ID NO: 3204 - RNA, 27 nt, Artificial Sequence
  Synthetic oligonucleotide
aucgggaaugcacgucgggcggucguc

SEQ ID NO: 3205 - RNA, 27 nt, Artificial Sequence
  Synthetic oligonucleotide
aaucgggaaugcacgucgggcggucgu

SEQ ID NO: 3206 - RNA, 27 nt, Artificial Sequence
  Synthetic oligonucleotide
gaaucgggaaugcacgucgggcggucg

SEQ ID NO: 3207 - RNA, 27 nt, Artificial Sequence
  Synthetic oligonucleotide
ggaaucgggaaugcacgucgggcgguc

SEQ ID NO: 3208 - RNA, 27 nt, Artificial Sequence
  Synthetic oligonucleotide
aggaaucgggaaugcacgucgggcggu

SEQ ID NO: 3209 - RNA, 27 nt, Artificial Sequence
  Synthetic oligonucleotide
aaggaaucgggaaugcacgucgggcgg

SEQ ID NO: 3210 - RNA, 27 nt, Artificial Sequence
  Synthetic oligonucleotide
aaaggaaucgggaaugcacgucgggcg

SEQ ID NO: 3211 - RNA, 27 nt, Artificial Sequence
  Synthetic oligonucleotide
aaaaggaaucgggaaugcacgucgggc

SEQ ID NO: 3212 - RNA, 27 nt, Artificial Sequence
  Synthetic oligonucleotide
caaaaggaaucgggaaugcacgucggg

SEQ ID NO: 3213 - RNA, 27 nt, Artificial Sequence
  Synthetic oligonucleotide
ccaaaaggaaucgggaaugcacgucgg

SEQ ID NO: 3214 - RNA, 27 nt, Artificial Sequence
  Synthetic oligonucleotide
accaaaaggaaucgggaaugcacgucg

SEQ ID NO: 3215 - RNA, 27 nt, Artificial Sequence
  Synthetic oligonucleotide
aaccaaaaggaaucgggaaugcacguc

SEQ ID NO: 3216 - RNA, 27 nt, Artificial Sequence
  Synthetic oligonucleotide
gaaccaaaaggaaucgggaaugcacgu

SEQ ID NO: 3217 - RNA, 27 nt, Artificial Sequence
  Synthetic oligonucleotide
ggaaccaaaaggaaucgggaaugcacg

SEQ ID NO: 3218 - RNA, 27 nt, Artificial Sequence
  Synthetic oligonucleotide
uggaaccaaaaggaaucgggaaugcac

SEQ ID NO: 3219 - RNA, 27 nt, Artificial Sequence
  Synthetic oligonucleotide
uuggaaccaaaaggaaucgggaaugca

SEQ ID NO: 3220 - RNA, 27 nt, Artificial Sequence
  Synthetic oligonucleotide
cuuggaaccaaaaggaaucgggaaugc

SEQ ID NO: 3221 - RNA, 27 nt, Artificial Sequence
  Synthetic oligonucleotide
acuuggaaccaaaaggaaucgggaaug

SEQ ID NO: 3222 - RNA, 27 nt, Artificial Sequence
  Synthetic oligonucleotide
gacuuggaaccaaaaggaaucgggaau

SEQ ID NO: 3223 - RNA, 27 nt, Artificial Sequence
  Synthetic oligonucleotide
ggacuuggaaccaaaaggaaucgggaa

SEQ ID NO: 3224 - RNA, 27 nt, Artificial Sequence
  Synthetic oligonucleotide
uggacuuggaaccaaaaggaaucggga

SEQ ID NO: 3225 - RNA, 27 nt, Artificial Sequence
  Synthetic oligonucleotide
uuggacuuggaaccaaaaggaaucggg

SEQ ID NO: 3226 - RNA, 27 nt, Artificial Sequence
  Synthetic oligonucleotide
auuggacuuggaaccaaaaggaaucgg

SEQ ID NO: 3227 - RNA, 27 nt, Artificial Sequence
  Synthetic oligonucleotide
uauuggacuuggaaccaaaaggaaucg

SEQ ID NO: 3228 - RNA, 27 nt, Artificial Sequence
  Synthetic oligonucleotide
auauuggacuuggaaccaaaaggaauc

SEQ ID NO: 3229 - RNA, 27 nt, Artificial Sequence
  Synthetic oligonucleotide
cauauuggacuuggaaccaaaaggaau

SEQ ID NO: 3230 - RNA, 27 nt, Artificial Sequence
  Synthetic oligonucleotide
ccauauuggacuuggaaccaaaaggaa

SEQ ID NO: 3231 - RNA, 27 nt, Artificial Sequence
  Synthetic oligonucleotide
gccauauuggacuuggaaccaaaagga

SEQ ID NO: 3232 - RNA, 27 nt, Artificial Sequence
  Synthetic oligonucleotide
ugccauauuggacuuggaaccaaaagg

SEQ ID NO: 3233 - RNA, 27 nt, Artificial Sequence
  Synthetic oligonucleotide
uugccauauuggacuuggaaccaaaag

SEQ ID NO: 3234 - RNA, 27 nt, Artificial Sequence
  Synthetic oligonucleotide
guugccauauuggacuuggaaccaaaa

SEQ ID NO: 3235 - RNA, 27 nt, Artificial Sequence
  Synthetic oligonucleotide
aguugccauauuggacuuggaaccaaa

SEQ ID NO: 3236 - RNA, 27 nt, Artificial Sequence
  Synthetic oligonucleotide
gaguugccauauuggacuuggaaccaa

SEQ ID NO: 3237 - RNA, 27 nt, Artificial Sequence
  Synthetic oligonucleotide
agaguugccauauuggacuuggaacca

SEQ ID NO: 3238 - RNA, 27 nt, Artificial Sequence
  Synthetic oligonucleotide
uagaguugccauauuggacuuggaacc

SEQ ID NO: 3239 - RNA, 27 nt, Artificial Sequence
  Synthetic oligonucleotide
uuagaguugccauauuggacuuggaac

SEQ ID NO: 3240 - RNA, 27 nt, Artificial Sequence
  Synthetic oligonucleotide
uuuagaguugccauauuggacuuggaa

SEQ ID NO: 3241 - RNA, 27 nt, Artificial Sequence
  Synthetic oligonucleotide
cuuuagaguugccauauuggacuugga

SEQ ID NO: 3242 - RNA, 27 nt, Artificial Sequence
  Synthetic oligonucleotide
ccuuuagaguugccauauuggacuugg

SEQ ID NO: 3243 - RNA, 27 nt, Artificial Sequence
  Synthetic oligonucleotide
uccuuuagaguugccauauuggacuug

SEQ ID NO: 3244 - RNA, 27 nt, Artificial Sequence
  Synthetic oligonucleotide
auccuuuagaguugccauauuggacuu

SEQ ID NO: 3245 - RNA, 27 nt, Artificial Sequence
  Synthetic oligonucleotide
gauccuuuagaguugccauauuggacu

SEQ ID NO: 3246 - RNA, 27 nt, Artificial Sequence
  Synthetic oligonucleotide
ugauccuuuagaguugccauauuggac

SEQ ID NO: 3247 - RNA, 27 nt, Artificial Sequence
  Synthetic oligonucleotide
cugauccuuuagaguugccauauugga

SEQ ID NO: 3248 - RNA, 27 nt, Artificial Sequence
  Synthetic oligonucleotide
gcugauccuuuagaguugccauauugg

SEQ ID NO: 3249 - RNA, 27 nt, Artificial Sequence
  Synthetic oligonucleotide
agcugauccuuuagaguugccauauug

SEQ ID NO: 3250 - RNA, 27 nt, Artificial Sequence
  Synthetic oligonucleotide
cagcugauccuuuagaguugccauauu

SEQ ID NO: 3251 - RNA, 27 nt, Artificial Sequence
  Synthetic oligonucleotide
ucagcugauccuuuagaguugccauau

SEQ ID NO: 3252 - RNA, 27 nt, Artificial Sequence
  Synthetic oligonucleotide
aucagcugauccuuuagaguugccaua

SEQ ID NO: 3253 - RNA, 27 nt, Artificial Sequence
  Synthetic oligonucleotide
aaucagcugauccuuuagaguugccau

SEQ ID NO: 3254 - RNA, 27 nt, Artificial Sequence
  Synthetic oligonucleotide
aaaucagcugauccuuuagaguugcca

SEQ ID NO: 3255 - RNA, 27 nt, Artificial Sequence
  Synthetic oligonucleotide
uaaaucagcugauccuuuagaguugcc

SEQ ID NO: 3256 - RNA, 27 nt, Artificial Sequence
  Synthetic oligonucleotide
auaaaucagcugauccuuuagaguugc

SEQ ID NO: 3257 - RNA, 27 nt, Artificial Sequence
  Synthetic oligonucleotide
uauaaaucagcugauccuuuagaguug

SEQ ID NO: 3258 - RNA, 27 nt, Artificial Sequence
  Synthetic oligonucleotide
uuauaaaucagcugauccuuuagaguu

SEQ ID NO: 3259 - RNA, 27 nt, Artificial Sequence
  Synthetic oligonucleotide
auuauaaaucagcugauccuuuagagu

SEQ ID NO: 3260 - RNA, 27 nt, Artificial Sequence
  Synthetic oligonucleotide
gauuauaaaucagcugauccuuuagag

SEQ ID NO: 3261 - RNA, 27 nt, Artificial Sequence
  Synthetic oligonucleotide
agauuauaaaucagcugauccuuuaga

SEQ ID NO: 3262 - RNA, 27 nt, Artificial Sequence
  Synthetic oligonucleotide
aagauuauaaaucagcugauccuuuag

SEQ ID NO: 3263 - RNA, 27 nt, Artificial Sequence
  Synthetic oligonucleotide
gaagauuauaaaucagcugauccuuua

SEQ ID NO: 3264 - RNA, 27 nt, Artificial Sequence
  Synthetic oligonucleotide
agaagauuauaaaucagcugauccuuu

SEQ ID NO: 3265 - RNA, 27 nt, Artificial Sequence
  Synthetic oligonucleotide
uagaagauuauaaaucagcugauccuu

SEQ ID NO: 3266 - RNA, 27 nt, Artificial Sequence
  Synthetic oligonucleotide
uuagaagauuauaaaucagcugauccu

SEQ ID NO: 3267 - RNA, 27 nt, Artificial Sequence
  Synthetic oligonucleotide
uuuagaagauuauaaaucagcugaucc

SEQ ID NO: 3268 - RNA, 27 nt, Artificial Sequence
  Synthetic oligonucleotide
cuuuagaagauuauaaaucagcugauc

SEQ ID NO: 3269 - RNA, 27 nt, Artificial Sequence
  Synthetic oligonucleotide
ccuuuagaagauuauaaaucagcugau

SEQ ID NO: 3270 - RNA, 27 nt, Artificial Sequence
  Synthetic oligonucleotide
uccuuuagaagauuauaaaucagcuga

SEQ ID NO: 3271 - RNA, 27 nt, Artificial Sequence
  Synthetic oligonucleotide
uuccuuuagaagauuauaaaucagcug

SEQ ID NO: 3272 - RNA, 27 nt, Artificial Sequence
  Synthetic oligonucleotide
cuuccuuuagaagauuauaaaucagcu

SEQ ID NO: 3273 - RNA, 27 nt, Artificial Sequence
  Synthetic oligonucleotide
ucuuccuuuagaagauuauaaaucagc

SEQ ID NO: 3274 - RNA, 27 nt, Artificial Sequence
  Synthetic oligonucleotide
uucuuccuuuagaagauuauaaaucag

SEQ ID NO: 3275 - RNA, 27 nt, Artificial Sequence
  Synthetic oligonucleotide
guucuuccuuuagaagauuauaaauca

SEQ ID NO: 3276 - RNA, 27 nt, Artificial Sequence
  Synthetic oligonucleotide
uguucuuccuuuagaagauuauaaauc

SEQ ID NO: 3277 - RNA, 27 nt, Artificial Sequence
  Synthetic oligonucleotide
cuguucuuccuuuagaagauuauaaau

SEQ ID NO: 3278 - RNA, 27 nt, Artificial Sequence
  Synthetic oligonucleotide
ucuguucuuccuuuagaagauuauaaa

SEQ ID NO: 3279 - RNA, 27 nt, Artificial Sequence
  Synthetic oligonucleotide
gucuguucuuccuuuagaagauuauaa

SEQ ID NO: 3280 - RNA, 27 nt, Artificial Sequence
  Synthetic oligonucleotide
ggucuguucuuccuuuagaagauuaua

SEQ ID NO: 3281 - RNA, 27 nt, Artificial Sequence
  Synthetic oligonucleotide
gggucuguucuuccuuuagaagauuau

SEQ ID NO: 3282 - RNA, 27 nt, Artificial Sequence
  Synthetic oligonucleotide
ggggucuguucuuccuuuagaagauua

SEQ ID NO: 3283 - RNA, 27 nt, Artificial Sequence
  Synthetic oligonucleotide
gggggucuguucuuccuuuagaagauu

SEQ ID NO: 3284 - RNA, 27 nt, Artificial Sequence
  Synthetic oligonucleotide
ggggggucuguucuuccuuuagaagau

SEQ ID NO: 3285 - RNA, 27 nt, Artificial Sequence
  Synthetic oligonucleotide
uggggggucuguucuuccuuuagaaga

SEQ ID NO: 3286 - RNA, 27 nt, Artificial Sequence
  Synthetic oligonucleotide
cuggggggucuguucuuccuuuagaag

SEQ ID NO: 3287 - RNA, 27 nt, Artificial Sequence
  Synthetic oligonucleotide
ucuggggggucuguucuuccuuuagaa

SEQ ID NO: 3288 - RNA, 27 nt, Artificial Sequence
  Synthetic oligonucleotide
uucuggggggucuguucuuccuuuaga

SEQ ID NO: 3289 - RNA, 27 nt, Artificial Sequence
  Synthetic oligonucleotide
auucuggggggucuguucuuccuuuag

SEQ ID NO: 3290 - RNA, 27 nt, Artificial Sequence
  Synthetic oligonucleotide
uauucuggggggucuguucuuccuuua

SEQ ID NO: 3291 - RNA, 27 nt, Artificial Sequence
  Synthetic oligonucleotide
uuauucuggggggucuguucuuccuuu

SEQ ID NO: 3292 - RNA, 27 nt, Artificial Sequence
  Synthetic oligonucleotide
cuuauucuggggggucuguucuuccuu

SEQ ID NO: 3293 - RNA, 27 nt, Artificial Sequence
  Synthetic oligonucleotide
ucuuauucuggggggucuguucuuccu

SEQ ID NO: 3294 - RNA, 27 nt, Artificial Sequence
  Synthetic oligonucleotide
aucuuauucuggggggucuguucuucc

SEQ ID NO: 3295 - RNA, 27 nt, Artificial Sequence
  Synthetic oligonucleotide
aaucuuauucuggggggucuguucuuc

SEQ ID NO: 3296 - RNA, 27 nt, Artificial Sequence
  Synthetic oligonucleotide
uaaucuuauucuggggggucuguucuu

SEQ ID NO: 3297 - RNA, 27 nt, Artificial Sequence
  Synthetic oligonucleotide
guaaucuuauucuggggggucuguucu

SEQ ID NO: 3298 - RNA, 27 nt, Artificial Sequence
  Synthetic oligonucleotide
uguaaucuuauucuggggggucuguuc

SEQ ID NO: 3299 - RNA, 27 nt, Artificial Sequence
  Synthetic oligonucleotide
cuguaaucuuauucuggggggucuguu

SEQ ID NO: 3300 - RNA, 27 nt, Artificial Sequence
  Synthetic oligonucleotide
acuguaaucuuauucuggggggucugu

SEQ ID NO: 3301 - RNA, 27 nt, Artificial Sequence
  Synthetic oligonucleotide
aacuguaaucuuauucuggggggucug

SEQ ID NO: 3302 - RNA, 27 nt, Artificial Sequence
  Synthetic oligonucleotide
caacuguaaucuuauucuggggggucu

SEQ ID NO: 3303 - RNA, 27 nt, Artificial Sequence
  Synthetic oligonucleotide
acaacuguaaucuuauucugggggguc

SEQ ID NO: 3304 - RNA, 27 nt, Artificial Sequence
  Synthetic oligonucleotide
aacaacuguaaucuuauucuggggggu

SEQ ID NO: 3305 - RNA, 27 nt, Artificial Sequence
  Synthetic oligonucleotide
caacaacuguaaucuuauucugggggg

SEQ ID NO: 3306 - RNA, 27 nt, Artificial Sequence
  Synthetic oligonucleotide
ccaacaacuguaaucuuauucuggggg

SEQ ID NO: 3307 - RNA, 27 nt, Artificial Sequence
  Synthetic oligonucleotide
cccaacaacuguaaucuuauucugggg

SEQ ID NO: 3308 - RNA, 27 nt, Artificial Sequence
  Synthetic oligonucleotide
ccccaacaacuguaaucuuauucuggg

SEQ ID NO: 3309 - RNA, 27 nt, Artificial Sequence
  Synthetic oligonucleotide
caaccccaacaacuguaaucuuauucu

SEQ ID NO: 3310 - RNA, 27 nt, Artificial Sequence
  Synthetic oligonucleotide
ccaaccccaacaacuguaaucuuauuc

SEQ ID NO: 3311 - RNA, 27 nt, Artificial Sequence
  Synthetic oligonucleotide
accaaccccaacaacuguaaucuuauu

SEQ ID NO: 3312 - RNA, 27 nt, Artificial Sequence
  Synthetic oligonucleotide
gccaacagcaccaaccccaacaacugu

SEQ ID NO: 3313 - RNA, 27 nt, Artificial Sequence
  Synthetic oligonucleotide
caugccaacagcaccaaccccaacaac

SEQ ID NO: 3314 - RNA, 27 nt, Artificial Sequence
  Synthetic oligonucleotide
ccaugccaacagcaccaaccccaacaa

SEQ ID NO: 3315 - RNA, 27 nt, Artificial Sequence
  Synthetic oligonucleotide
gccaugccaacagcaccaaccccaaca

SEQ ID NO: 3316 - RNA, 27 nt, Artificial Sequence
  Synthetic oligonucleotide
ggccaugccaacagcaccaaccccaac

SEQ ID NO: 3317 - RNA, 27 nt, Artificial Sequence
  Synthetic oligonucleotide
aggccaugccaacagcaccaaccccaa

SEQ ID NO: 3318 - RNA, 27 nt, Artificial Sequence
  Synthetic oligonucleotide
caggccaugccaacagcaccaacccca

SEQ ID NO: 3319 - RNA, 27 nt, Artificial Sequence
  Synthetic oligonucleotide
acaggccaugccaacagcaccaacccc

SEQ ID NO: 3320 - RNA, 27 nt, Artificial Sequence
  Synthetic oligonucleotide
cacaggccaugccaacagcaccaaccc

SEQ ID NO: 3321 - RNA, 27 nt, Artificial Sequence
  Synthetic oligonucleotide
gcacaggccaugccaacagcaccaacc

SEQ ID NO: 3322 - RNA, 27 nt, Artificial Sequence
  Synthetic oligonucleotide
ggcacaggccaugccaacagcaccaac

SEQ ID NO: 3323 - RNA, 27 nt, Artificial Sequence
  Synthetic oligonucleotide
uggcacaggccaugccaacagcaccaa

SEQ ID NO: 3324 - RNA, 27 nt, Artificial Sequence
  Synthetic oligonucleotide
auggcacaggccaugccaacagcacca

SEQ ID NO: 3325 - RNA, 27 nt, Artificial Sequence
  Synthetic oligonucleotide
gauggcacaggccaugccaacagcacc

SEQ ID NO: 3326 - RNA, 27 nt, Artificial Sequence
  Synthetic oligonucleotide
ugauggcacaggccaugccaacagcac

SEQ ID NO: 3327 - RNA, 27 nt, Artificial Sequence
  Synthetic oligonucleotide
cugauggcacaggccaugccaacagca

SEQ ID NO: 3328 - RNA, 27 nt, Artificial Sequence
  Synthetic oligonucleotide
acugauggcacaggccaugccaacagc

SEQ ID NO: 3329 - RNA, 27 nt, Artificial Sequence
  Synthetic oligonucleotide
uacugauggcacaggccaugccaacag

SEQ ID NO: 3330 - RNA, 27 nt, Artificial Sequence
  Synthetic oligonucleotide
auacugauggcacaggccaugccaaca

SEQ ID NO: 3331 - RNA, 27 nt, Artificial Sequence
  Synthetic oligonucleotide
gauacugauggcacaggccaugccaac

SEQ ID NO: 3332 - RNA, 27 nt, Artificial Sequence
  Synthetic oligonucleotide
agauacugauggcacaggccaugccaa

SEQ ID NO: 3333 - RNA, 27 nt, Artificial Sequence
  Synthetic oligonucleotide
aagauacugauggcacaggccaugcca

SEQ ID NO: 3334 - RNA, 27 nt, Artificial Sequence
  Synthetic oligonucleotide
uaagauacugauggcacaggccaugcc

SEQ ID NO: 3335 - RNA, 27 nt, Artificial Sequence
  Synthetic oligonucleotide
uuaagauacugauggcacaggccaugc

SEQ ID NO: 3336 - RNA, 27 nt, Artificial Sequence
  Synthetic oligonucleotide
auuaagauacugauggcacaggccaug

SEQ ID NO: 3337 - RNA, 27 nt, Artificial Sequence
  Synthetic oligonucleotide
cauuaagauacugauggcacaggccau

SEQ ID NO: 3338 - RNA, 27 nt, Artificial Sequence
  Synthetic oligonucleotide
ucauuaagauacugauggcacaggcca

SEQ ID NO: 3339 - RNA, 27 nt, Artificial Sequence
  Synthetic oligonucleotide
ccaaguccuucauuaagauacugaugg

SEQ ID NO: 3340 - RNA, 27 nt, Artificial Sequence
  Synthetic oligonucleotide
gccaaguccuucauuaagauacugaug

SEQ ID NO: 3341 - RNA, 27 nt, Artificial Sequence
  Synthetic oligonucleotide
ugccaaguccuucauuaagauacugau

SEQ ID NO: 3342 - RNA, 27 nt, Artificial Sequence
  Synthetic oligonucleotide
cugccaaguccuucauuaagauacuga

SEQ ID NO: 3343 - RNA, 27 nt, Artificial Sequence
  Synthetic oligonucleotide
ucugccaaguccuucauuaagauacug

SEQ ID NO: 3344 - RNA, 27 nt, Artificial Sequence
  Synthetic oligonucleotide
aucugccaaguccuucauuaagauacu

SEQ ID NO: 3345 - RNA, 27 nt, Artificial Sequence
  Synthetic oligonucleotide
caucugccaaguccuucauuaagauac

SEQ ID NO: 3346 - RNA, 27 nt, Artificial Sequence
  Synthetic oligonucleotide
ucaucugccaaguccuucauuaagaua

SEQ ID NO: 3347 - RNA, 27 nt, Artificial Sequence
  Synthetic oligonucleotide
uucaucugccaaguccuucauuaagau

SEQ ID NO: 3348 - RNA, 27 nt, Artificial Sequence
  Synthetic oligonucleotide
guucaucugccaaguccuucauuaaga

SEQ ID NO: 3349 - RNA, 27 nt, Artificial Sequence
  Synthetic oligonucleotide
aguucaucugccaaguccuucauuaag

SEQ ID NO: 3350 - RNA, 27 nt, Artificial Sequence
  Synthetic oligonucleotide
aaguucaucugccaaguccuucauuaa

SEQ ID NO: 3351 - RNA, 27 nt, Artificial Sequence
  Synthetic oligonucleotide
caaguucaucugccaaguccuucauua

SEQ ID NO: 3352 - RNA, 27 nt, Artificial Sequence
  Synthetic oligonucleotide
gcaaguucaucugccaaguccuucauu

SEQ ID NO: 3353 - RNA, 27 nt, Artificial Sequence
  Synthetic oligonucleotide
agcaaguucaucugccaaguccuucau

SEQ ID NO: 3354 - RNA, 27 nt, Artificial Sequence
  Synthetic oligonucleotide
gagcaaguucaucugccaaguccuuca

SEQ ID NO: 3355 - RNA, 27 nt, Artificial Sequence
  Synthetic oligonucleotide
agagcaaguucaucugccaaguccuuc

SEQ ID NO: 3356 - RNA, 27 nt, Artificial Sequence
  Synthetic oligonucleotide
aagagcaaguucaucugccaaguccuu

SEQ ID NO: 3357 - RNA, 27 nt, Artificial Sequence
  Synthetic oligonucleotide
caagagcaaguucaucugccaaguccu

SEQ ID NO: 3358 - RNA, 27 nt, Artificial Sequence
  Synthetic oligonucleotide
acaagagcaaguucaucugccaagucc

SEQ ID NO: 3359 - RNA, 27 nt, Artificial Sequence
  Synthetic oligonucleotide
aacaagagcaaguucaucugccaaguc

SEQ ID NO: 3360 - RNA, 27 nt, Artificial Sequence
  Synthetic oligonucleotide
caacaagagcaaguucaucugccaagu

SEQ ID NO: 3361 - RNA, 27 nt, Artificial Sequence
  Synthetic oligonucleotide
ucaacaagagcaaguucaucugccaag

SEQ ID NO: 3362 - RNA, 27 nt, Artificial Sequence
  Synthetic oligonucleotide
aucaacaagagcaaguucaucugccaa

SEQ ID NO: 3363 - RNA, 27 nt, Artificial Sequence
  Synthetic oligonucleotide
caucaacaagagcaaguucaucugcca

SEQ ID NO: 3364 - RNA, 27 nt, Artificial Sequence
  Synthetic oligonucleotide
acaucaacaagagcaaguucaucugcc

SEQ ID NO: 3365 - RNA, 27 nt, Artificial Sequence
  Synthetic oligonucleotide
gacaucaacaagagcaaguucaucugc

SEQ ID NO: 3366 - RNA, 27 nt, Artificial Sequence
  Synthetic oligonucleotide
ugacaucaacaagagcaaguucaucug

SEQ ID NO: 3367 - RNA, 27 nt, Artificial Sequence
  Synthetic oligonucleotide
augacaucaacaagagcaaguucaucu

SEQ ID NO: 3368 - RNA, 27 nt, Artificial Sequence
  Synthetic oligonucleotide
gaugacaucaacaagagcaaguucauc

SEQ ID NO: 3369 - RNA, 27 nt, Artificial Sequence
  Synthetic oligonucleotide
cgaugacaucaacaagagcaaguucau

SEQ ID NO: 3370 - RNA, 27 nt, Artificial Sequence
  Synthetic oligonucleotide
ucgaugacaucaacaagagcaaguuca

SEQ ID NO: 3371 - RNA, 27 nt, Artificial Sequence
  Synthetic oligonucleotide
uucgaugacaucaacaagagcaaguuc

SEQ ID NO: 3372 - RNA, 27 nt, Artificial Sequence
  Synthetic oligonucleotide
cuucgaugacaucaacaagagcaaguu

SEQ ID NO: 3373 - RNA, 27 nt, Artificial Sequence
  Synthetic oligonucleotide
ucuucgaugacaucaacaagagcaagu

SEQ ID NO: 3374 - RNA, 27 nt, Artificial Sequence
  Synthetic oligonucleotide
gucuucgaugacaucaacaagagcaag

SEQ ID NO: 3375 - RNA, 27 nt, Artificial Sequence
  Synthetic oligonucleotide
ugucuucgaugacaucaacaagagcaa

SEQ ID NO: 3376 - RNA, 27 nt, Artificial Sequence
  Synthetic oligonucleotide
uugucuucgaugacaucaacaagagca

SEQ ID NO: 3377 - RNA, 27 nt, Artificial Sequence
  Synthetic oligonucleotide
uuugucuucgaugacaucaacaagagc

SEQ ID NO: 3378 - RNA, 27 nt, Artificial Sequence
  Synthetic oligonucleotide
auuugucuucgaugacaucaacaagag

SEQ ID NO: 3379 - RNA, 27 nt, Artificial Sequence
  Synthetic oligonucleotide
aauuugucuucgaugacaucaacaaga

SEQ ID NO: 3380 - RNA, 27 nt, Artificial Sequence
  Synthetic oligonucleotide
caauuugucuucgaugacaucaacaag

SEQ ID NO: 3381 - RNA, 27 nt, Artificial Sequence
  Synthetic oligonucleotide
ucaauuugucuucgaugacaucaacaa

SEQ ID NO: 3382 - RNA, 27 nt, Artificial Sequence
  Synthetic oligonucleotide
uucaauuugucuucgaugacaucaaca

SEQ ID NO: 3383 - RNA, 27 nt, Artificial Sequence
  Synthetic oligonucleotide
cuucaauuugucuucgaugacaucaac

SEQ ID NO: 3384 - RNA, 27 nt, Artificial Sequence
  Synthetic oligonucleotide
ccuucaauuugucuucgaugacaucaa

SEQ ID NO: 3385 - RNA, 27 nt, Artificial Sequence
  Synthetic oligonucleotide
cccuucaauuugucuucgaugacauca

SEQ ID NO: 3386 - RNA, 27 nt, Artificial Sequence
  Synthetic oligonucleotide
ucccuucaauuugucuucgaugacauc

SEQ ID NO: 3387 - RNA, 27 nt, Artificial Sequence
  Synthetic oligonucleotide
cucccuucaauuugucuucgaugacau

SEQ ID NO: 3388 - RNA, 27 nt, Artificial Sequence
  Synthetic oligonucleotide
ucucccuucaauuugucuucgaugaca

SEQ ID NO: 3389 - RNA, 27 nt, Artificial Sequence
  Synthetic oligonucleotide
cucucccuucaauuugucuucgaugac

SEQ ID NO: 3390 - RNA, 27 nt, Artificial Sequence
  Synthetic oligonucleotide
ucucucccuucaauuugucuucgauga

SEQ ID NO: 3391 - RNA, 27 nt, Artificial Sequence
  Synthetic oligonucleotide
aucucucccuucaauuugucuucgaug

SEQ ID NO: 3392 - RNA, 27 nt, Artificial Sequence
  Synthetic oligonucleotide
caucucucccuucaauuugucuucgau

SEQ ID NO: 3393 - RNA, 27 nt, Artificial Sequence
  Synthetic oligonucleotide
ucaucucucccuucaauuugucuucga

SEQ ID NO: 3394 - RNA, 27 nt, Artificial Sequence
  Synthetic oligonucleotide
aucaucucucccuucaauuugucuucg

SEQ ID NO: 3395 - RNA, 27 nt, Artificial Sequence
  Synthetic oligonucleotide
caucaucucucccuucaauuugucuuc

SEQ ID NO: 3396 - RNA, 27 nt, Artificial Sequence
  Synthetic oligonucleotide
ccaucaucucucccuucaauuugucuu

SEQ ID NO: 3397 - RNA, 27 nt, Artificial Sequence
  Synthetic oligonucleotide
uccaucaucucucccuucaauuugucu

SEQ ID NO: 3398 - RNA, 27 nt, Artificial Sequence
  Synthetic oligonucleotide
auccaucaucucucccuucaauuuguc

SEQ ID NO: 3399 - RNA, 27 nt, Artificial Sequence
  Synthetic oligonucleotide
gauccaucaucucucccuucaauuugu

SEQ ID NO: 3400 - RNA, 27 nt, Artificial Sequence
  Synthetic oligonucleotide
agauccaucaucucucccuucaauuug

SEQ ID NO: 3401 - RNA, 27 nt, Artificial Sequence
  Synthetic oligonucleotide
gagauccaucaucucucccuucaauuu

SEQ ID NO: 3402 - RNA, 27 nt, Artificial Sequence
  Synthetic oligonucleotide
ggagauccaucaucucucccuucaauu

SEQ ID NO: 3403 - RNA, 27 nt, Artificial Sequence
  Synthetic oligonucleotide
uggagauccaucaucucucccuucaau

SEQ ID NO: 3404 - RNA, 27 nt, Artificial Sequence
  Synthetic oligonucleotide
uuggagauccaucaucucucccuucaa

SEQ ID NO: 3405 - RNA, 27 nt, Artificial Sequence
  Synthetic oligonucleotide
guuggagauccaucaucucucccuuca

SEQ ID NO: 3406 - RNA, 27 nt, Artificial Sequence
  Synthetic oligonucleotide
uguuggagauccaucaucucucccuuc

SEQ ID NO: 3407 - RNA, 27 nt, Artificial Sequence
  Synthetic oligonucleotide
auguuggagauccaucaucucucccuu

SEQ ID NO: 3408 - RNA, 27 nt, Artificial Sequence
  Synthetic oligonucleotide
cauguuggagauccaucaucucucccu

SEQ ID NO: 3409 - RNA, 27 nt, Artificial Sequence
  Synthetic oligonucleotide
ccauguuggagauccaucaucucuccc

SEQ ID NO: 3410 - RNA, 27 nt, Artificial Sequence
  Synthetic oligonucleotide
gccauguuggagauccaucaucucucc

SEQ ID NO: 3411 - RNA, 27 nt, Artificial Sequence
  Synthetic oligonucleotide
ugccauguuggagauccaucaucucuc

SEQ ID NO: 3412 - RNA, 27 nt, Artificial Sequence
  Synthetic oligonucleotide
cugccauguuggagauccaucaucucu

SEQ ID NO: 3413 - RNA, 27 nt, Artificial Sequence
  Synthetic oligonucleotide
gcugccauguuggagauccaucaucuc

SEQ ID NO: 3414 - RNA, 27 nt, Artificial Sequence
  Synthetic oligonucleotide
ggcugccauguuggagauccaucaucu

SEQ ID NO: 3415 - RNA, 27 nt, Artificial Sequence
  Synthetic oligonucleotide
aggcugccauguuggagauccaucauc

SEQ ID NO: 3416 - RNA, 27 nt, Artificial Sequence
  Synthetic oligonucleotide
aaggcugccauguuggagauccaucau

SEQ ID NO: 3417 - RNA, 27 nt, Artificial Sequence
  Synthetic oligonucleotide
aaaggcugccauguuggagauccauca

SEQ ID NO: 3418 - RNA, 27 nt, Artificial Sequence
  Synthetic oligonucleotide
aaaaggcugccauguuggagauccauc

SEQ ID NO: 3419 - RNA, 27 nt, Artificial Sequence
  Synthetic oligonucleotide
gaaaaggcugccauguuggagauccau

SEQ ID NO: 3420 - RNA, 27 nt, Artificial Sequence
  Synthetic oligonucleotide
ggaaaaggcugccauguuggagaucca

SEQ ID NO: 3421 - RNA, 27 nt, Artificial Sequence
  Synthetic oligonucleotide
aggaaaaggcugccauguuggagaucc

SEQ ID NO: 3422 - RNA, 27 nt, Artificial Sequence
  Synthetic oligonucleotide
aaggaaaaggcugccauguuggagauc

SEQ ID NO: 3423 - RNA, 27 nt, Artificial Sequence
  Synthetic oligonucleotide
uaaggaaaaggcugccauguuggagau

SEQ ID NO: 3424 - RNA, 27 nt, Artificial Sequence
  Synthetic oligonucleotide
cuaaggaaaaggcugccauguuggaga

SEQ ID NO: 3425 - RNA, 27 nt, Artificial Sequence
  Synthetic oligonucleotide
ucuaaggaaaaggcugccauguuggag

SEQ ID NO: 3426 - RNA, 27 nt, Artificial Sequence
  Synthetic oligonucleotide
uucuaaggaaaaggcugccauguugga

SEQ ID NO: 3427 - RNA, 27 nt, Artificial Sequence
  Synthetic oligonucleotide
guucuaaggaaaaggcugccauguugg

SEQ ID NO: 3428 - RNA, 27 nt, Artificial Sequence
  Synthetic oligonucleotide
uguucuaaggaaaaggcugccauguug

SEQ ID NO: 3429 - RNA, 27 nt, Artificial Sequence
  Synthetic oligonucleotide
guguucuaaggaaaaggcugccauguu

SEQ ID NO: 3430 - RNA, 27 nt, Artificial Sequence
  Synthetic oligonucleotide
gguguucuaaggaaaaggcugccaugu

SEQ ID NO: 3431 - RNA, 27 nt, Artificial Sequence
  Synthetic oligonucleotide
ugguguucuaaggaaaaggcugccaug

SEQ ID NO: 3432 - RNA, 27 nt, Artificial Sequence
  Synthetic oligonucleotide
uugguguucuaaggaaaaggcugccau

SEQ ID NO: 3433 - RNA, 27 nt, Artificial Sequence
  Synthetic oligonucleotide
uuugguguucuaaggaaaaggcugcca

SEQ ID NO: 3434 - RNA, 27 nt, Artificial Sequence
  Synthetic oligonucleotide
cuuugguguucuaaggaaaaggcugcc

SEQ ID NO: 3435 - RNA, 27 nt, Artificial Sequence
  Synthetic oligonucleotide
ucuuugguguucuaaggaaaaggcugc

SEQ ID NO: 3436 - RNA, 27 nt, Artificial Sequence
  Synthetic oligonucleotide
aucuuugguguucuaaggaaaaggcug

SEQ ID NO: 3437 - RNA, 27 nt, Artificial Sequence
  Synthetic oligonucleotide
aaucuuugguguucuaaggaaaaggcu

SEQ ID NO: 3438 - RNA, 27 nt, Artificial Sequence
  Synthetic oligonucleotide
caaucuuugguguucuaaggaaaaggc

SEQ ID NO: 3439 - RNA, 27 nt, Artificial Sequence
  Synthetic oligonucleotide
acaaucuuugguguucuaaggaaaagg

SEQ ID NO: 3440 - RNA, 27 nt, Artificial Sequence
  Synthetic oligonucleotide
gacaaucuuugguguucuaaggaaaag

SEQ ID NO: 3441 - RNA, 27 nt, Artificial Sequence
  Synthetic oligonucleotide
agacaaucuuugguguucuaaggaaaa

SEQ ID NO: 3442 - RNA, 27 nt, Artificial Sequence
  Synthetic oligonucleotide
gagacaaucuuugguguucuaaggaaa

SEQ ID NO: 3443 - RNA, 27 nt, Artificial Sequence
  Synthetic oligonucleotide
agagacaaucuuugguguucuaaggaa

SEQ ID NO: 3444 - RNA, 27 nt, Artificial Sequence
  Synthetic oligonucleotide
cagagacaaucuuugguguucuaagga

SEQ ID NO: 3445 - RNA, 27 nt, Artificial Sequence
  Synthetic oligonucleotide
ccagagacaaucuuugguguucuaagg

SEQ ID NO: 3446 - RNA, 27 nt, Artificial Sequence
  Synthetic oligonucleotide
gccagagacaaucuuugguguucuaag

SEQ ID NO: 3447 - RNA, 27 nt, Artificial Sequence
  Synthetic oligonucleotide
ugccagagacaaucuuugguguucuaa

SEQ ID NO: 3448 - RNA, 27 nt, Artificial Sequence
  Synthetic oligonucleotide
uugccagagacaaucuuugguguucua

SEQ ID NO: 3449 - RNA, 27 nt, Artificial Sequence
  Synthetic oligonucleotide
uuugccagagacaaucuuugguguucu

SEQ ID NO: 3450 - RNA, 27 nt, Artificial Sequence
  Synthetic oligonucleotide
cuuugccagagacaaucuuugguguuc

SEQ ID NO: 3451 - RNA, 27 nt, Artificial Sequence
  Synthetic oligonucleotide
ucuuugccagagacaaucuuugguguu

SEQ ID NO: 3452 - RNA, 27 nt, Artificial Sequence
  Synthetic oligonucleotide
gucuuugccagagacaaucuuuggugu

SEQ ID NO: 3453 - RNA, 27 nt, Artificial Sequence
  Synthetic oligonucleotide
agucuuugccagagacaaucuuuggug

SEQ ID NO: 3454 - RNA, 27 nt, Artificial Sequence
  Synthetic oligonucleotide
uagucuuugccagagacaaucuuuggu

SEQ ID NO: 3455 - RNA, 27 nt, Artificial Sequence
  Synthetic oligonucleotide
auagucuuugccagagacaaucuuugg

SEQ ID NO: 3456 - RNA, 27 nt, Artificial Sequence
  Synthetic oligonucleotide
uauagucuuugccagagacaaucuuug

SEQ ID NO: 3457 - RNA, 27 nt, Artificial Sequence
  Synthetic oligonucleotide
uuauagucuuugccagagacaaucuuu

SEQ ID NO: 3458 - RNA, 27 nt, Artificial Sequence
  Synthetic oligonucleotide
auuauagucuuugccagagacaaucuu

SEQ ID NO: 3459 - RNA, 27 nt, Artificial Sequence
  Synthetic oligonucleotide
cauuauagucuuugccagagacaaucu

SEQ ID NO: 3460 - RNA, 27 nt, Artificial Sequence
  Synthetic oligonucleotide
acauuauagucuuugccagagacaauc

SEQ ID NO: 3461 - RNA, 27 nt, Artificial Sequence
  Synthetic oligonucleotide
uacauuauagucuuugccagagacaau

SEQ ID NO: 3462 - RNA, 27 nt, Artificial Sequence
  Synthetic oligonucleotide
uuacauuauagucuuugccagagacaa

SEQ ID NO: 3463 - RNA, 27 nt, Artificial Sequence
  Synthetic oligonucleotide
guuacauuauagucuuugccagagaca

SEQ ID NO: 3464 - RNA, 27 nt, Artificial Sequence
  Synthetic oligonucleotide
aguuacauuauagucuuugccagagac

SEQ ID NO: 3465 - RNA, 27 nt, Artificial Sequence
  Synthetic oligonucleotide
caguuacauuauagucuuugccagaga

SEQ ID NO: 3466 - RNA, 27 nt, Artificial Sequence
  Synthetic oligonucleotide
gcaguuacauuauagucuuugccagag

SEQ ID NO: 3467 - RNA, 27 nt, Artificial Sequence
  Synthetic oligonucleotide
ugcaguuacauuauagucuuugccaga

SEQ ID NO: 3468 - RNA, 27 nt, Artificial Sequence
  Synthetic oligonucleotide
uugcaguuacauuauagucuuugccag

SEQ ID NO: 3469 - RNA, 27 nt, Artificial Sequence
  Synthetic oligonucleotide
uuugcaguuacauuauagucuuugcca

SEQ ID NO: 3470 - RNA, 27 nt, Artificial Sequence
  Synthetic oligonucleotide
guuugcaguuacauuauagucuuugcc

SEQ ID NO: 3471 - RNA, 27 nt, Artificial Sequence
  Synthetic oligonucleotide
aguuugcaguuacauuauagucuuugc

SEQ ID NO: 3472 - RNA, 27 nt, Artificial Sequence
  Synthetic oligonucleotide
gaguuugcaguuacauuauagucuuug

SEQ ID NO: 3473 - RNA, 27 nt, Artificial Sequence
  Synthetic oligonucleotide
ggaguuugcaguuacauuauagucuuu

SEQ ID NO: 3474 - RNA, 27 nt, Artificial Sequence
  Synthetic oligonucleotide
uggaguuugcaguuacauuauagucuu

SEQ ID NO: 3475 - RNA, 27 nt, Artificial Sequence
  Synthetic oligonucleotide
uuggaguuugcaguuacauuauagucu

SEQ ID NO: 3476 - RNA, 27 nt, Artificial Sequence
  Synthetic oligonucleotide
cuuggaguuugcaguuacauuauaguc

SEQ ID NO: 3477 - RNA, 27 nt, Artificial Sequence
  Synthetic oligonucleotide
gcuuggaguuugcaguuacauuauagu

SEQ ID NO: 3478 - RNA, 27 nt, Artificial Sequence
  Synthetic oligonucleotide
agcuuggaguuugcaguuacauuauag

SEQ ID NO: 3479 - RNA, 27 nt, Artificial Sequence
  Synthetic oligonucleotide
cagcuuggaguuugcaguuacauuaua

SEQ ID NO: 3480 - RNA, 27 nt, Artificial Sequence
  Synthetic oligonucleotide
ccagcuuggaguuugcaguuacauuau

SEQ ID NO: 3481 - RNA, 27 nt, Artificial Sequence
  Synthetic oligonucleotide
accagcuuggaguuugcaguuacauua

SEQ ID NO: 3482 - RNA, 27 nt, Artificial Sequence
  Synthetic oligonucleotide
gaccagcuuggaguuugcaguuacauu

SEQ ID NO: 3483 - RNA, 27 nt, Artificial Sequence
  Synthetic oligonucleotide
ugaccagcuuggaguuugcaguuacau

SEQ ID NO: 3484 - RNA, 27 nt, Artificial Sequence
  Synthetic oligonucleotide
augaccagcuuggaguuugcaguuaca

SEQ ID NO: 3485 - RNA, 27 nt, Artificial Sequence
  Synthetic oligonucleotide
aaugaccagcuuggaguuugcaguuac

SEQ ID NO: 3486 - RNA, 27 nt, Artificial Sequence
  Synthetic oligonucleotide
uaaugaccagcuuggaguuugcaguua

SEQ ID NO: 3487 - RNA, 27 nt, Artificial Sequence
  Synthetic oligonucleotide
auaaugaccagcuuggaguuugcaguu

SEQ ID NO: 3488 - RNA, 27 nt, Artificial Sequence
  Synthetic oligonucleotide
gauaaugaccagcuuggaguuugcagu

SEQ ID NO: 3489 - RNA, 27 nt, Artificial Sequence
  Synthetic oligonucleotide
ugauaaugaccagcuuggaguuugcag

SEQ ID NO: 3490 - RNA, 27 nt, Artificial Sequence
  Synthetic oligonucleotide
gugauaaugaccagcuuggaguuugca

SEQ ID NO: 3491 - RNA, 27 nt, Artificial Sequence
  Synthetic oligonucleotide
cgugauaaugaccagcuuggaguuugc

SEQ ID NO: 3492 - RNA, 27 nt, Artificial Sequence
  Synthetic oligonucleotide
ccgugauaaugaccagcuuggaguuug

SEQ ID NO: 3493 - RNA, 27 nt, Artificial Sequence
  Synthetic oligonucleotide
gccgugauaaugaccagcuuggaguuu

SEQ ID NO: 3494 - RNA, 27 nt, Artificial Sequence
  Synthetic oligonucleotide
agccgugauaaugaccagcuuggaguu

SEQ ID NO: 3495 - RNA, 27 nt, Artificial Sequence
  Synthetic oligonucleotide
cagccgugauaaugaccagcuuggagu

SEQ ID NO: 3496 - RNA, 27 nt, Artificial Sequence
  Synthetic oligonucleotide
ccagccgugauaaugaccagcuuggag

SEQ ID NO: 3497 - RNA, 27 nt, Artificial Sequence
  Synthetic oligonucleotide
cccagccgugauaaugaccagcuugga

SEQ ID NO: 3498 - RNA, 27 nt, Artificial Sequence
  Synthetic oligonucleotide
ccccagccgugauaaugaccagcuugg

SEQ ID NO: 3499 - RNA, 27 nt, Artificial Sequence
  Synthetic oligonucleotide
gccccagccgugauaaugaccagcuug

SEQ ID NO: 3500 - RNA, 27 nt, Artificial Sequence
  Synthetic oligonucleotide
ugccccagccgugauaaugaccagcuu

SEQ ID NO: 3501 - RNA, 27 nt, Artificial Sequence
  Synthetic oligonucleotide
gugccccagccgugauaaugaccagcu

SEQ ID NO: 3502 - RNA, 27 nt, Artificial Sequence
  Synthetic oligonucleotide
cgugccccagccgugauaaugaccagc

SEQ ID NO: 3503 - RNA, 27 nt, Artificial Sequence
  Synthetic oligonucleotide
acgugccccagccgugauaaugaccag

SEQ ID NO: 3504 - RNA, 27 nt, Artificial Sequence
  Synthetic oligonucleotide
gacgugccccagccgugauaaugacca

SEQ ID NO: 3505 - RNA, 27 nt, Artificial Sequence
  Synthetic oligonucleotide
ugacgugccccagccgugauaaugacc

SEQ ID NO: 3506 - RNA, 27 nt, Artificial Sequence
  Synthetic oligonucleotide
cugacgugccccagccgugauaaugac

SEQ ID NO: 3507 - RNA, 27 nt, Artificial Sequence
  Synthetic oligonucleotide
gcugacgugccccagccgugauaauga

SEQ ID NO: 3508 - RNA, 27 nt, Artificial Sequence
  Synthetic oligonucleotide
ugcugacgugccccagccgugauaaug

SEQ ID NO: 3509 - RNA, 27 nt, Artificial Sequence
  Synthetic oligonucleotide
uugcugacgugccccagccgugauaau

SEQ ID NO: 3510 - RNA, 27 nt, Artificial Sequence
  Synthetic oligonucleotide
cuugcugacgugccccagccgugauaa

SEQ ID NO: 3511 - RNA, 27 nt, Artificial Sequence
  Synthetic oligonucleotide
ucuugcugacgugccccagccgugaua

SEQ ID NO: 3512 - RNA, 27 nt, Artificial Sequence
  Synthetic oligonucleotide
cucuugcugacgugccccagccgugau

SEQ ID NO: 3513 - RNA, 27 nt, Artificial Sequence
  Synthetic oligonucleotide
ccucuugcugacgugccccagccguga

SEQ ID NO: 3514 - RNA, 27 nt, Artificial Sequence
  Synthetic oligonucleotide
cccucuugcugacgugccccagccgug

SEQ ID NO: 3515 - RNA, 27 nt, Artificial Sequence
  Synthetic oligonucleotide
ucccucuugcugacgugccccagccgu

SEQ ID NO: 3516 - RNA, 27 nt, Artificial Sequence
  Synthetic oligonucleotide
cucccucuugcugacgugccccagccg

SEQ ID NO: 3517 - RNA, 27 nt, Artificial Sequence
  Synthetic oligonucleotide
ucucccucuugcugacgugccccagcc

SEQ ID NO: 3518 - RNA, 27 nt, Artificial Sequence
  Synthetic oligonucleotide
uucucccucuugcugacgugccccagc

SEQ ID NO: 3519 - RNA, 27 nt, Artificial Sequence
  Synthetic oligonucleotide
uuucucccucuugcugacgugccccag

SEQ ID NO: 3520 - RNA, 27 nt, Artificial Sequence
  Synthetic oligonucleotide
cuuucucccucuugcugacgugcccca

SEQ ID NO: 3521 - RNA, 27 nt, Artificial Sequence
  Synthetic oligonucleotide
gcuuucucccucuugcugacgugcccc

SEQ ID NO: 3522 - RNA, 27 nt, Artificial Sequence
  Synthetic oligonucleotide
ggcuuucucccucuugcugacgugccc

SEQ ID NO: 3523 - RNA, 27 nt, Artificial Sequence
  Synthetic oligonucleotide
cggcuuucucccucuugcugacgugcc

SEQ ID NO: 3524 - RNA, 27 nt, Artificial Sequence
  Synthetic oligonucleotide
acggcuuucucccucuugcugacgugc

SEQ ID NO: 3525 - RNA, 27 nt, Artificial Sequence
  Synthetic oligonucleotide
gacggcuuucucccucuugcugacgug

SEQ ID NO: 3526 - RNA, 27 nt, Artificial Sequence
  Synthetic oligonucleotide
agacggcuuucucccucuugcugacgu

SEQ ID NO: 3527 - RNA, 27 nt, Artificial Sequence
  Synthetic oligonucleotide
aagacggcuuucucccucuugcugacg

SEQ ID NO: 3528 - RNA, 27 nt, Artificial Sequence
  Synthetic oligonucleotide
uaagacggcuuucucccucuugcugac

SEQ ID NO: 3529 - RNA, 27 nt, Artificial Sequence
  Synthetic oligonucleotide
uuaagacggcuuucucccucuugcuga

SEQ ID NO: 3530 - RNA, 27 nt, Artificial Sequence
  Synthetic oligonucleotide
auuaagacggcuuucucccucuugcug

SEQ ID NO: 3531 - RNA, 27 nt, Artificial Sequence
  Synthetic oligonucleotide
aauuaagacggcuuucucccucuugcu

SEQ ID NO: 3532 - RNA, 27 nt, Artificial Sequence
  Synthetic oligonucleotide
aaauuaagacggcuuucucccucuugc

SEQ ID NO: 3533 - RNA, 27 nt, Artificial Sequence
  Synthetic oligonucleotide
caaauuaagacggcuuucucccucuug

SEQ ID NO: 3534 - RNA, 27 nt, Artificial Sequence
  Synthetic oligonucleotide
ccaaauuaagacggcuuucucccucuu

SEQ ID NO: 3535 - RNA, 27 nt, Artificial Sequence
  Synthetic oligonucleotide
accaaauuaagacggcuuucucccucu

SEQ ID NO: 3536 - RNA, 27 nt, Artificial Sequence
  Synthetic oligonucleotide
gaccaaauuaagacggcuuucucccuc

SEQ ID NO: 3537 - RNA, 27 nt, Artificial Sequence
  Synthetic oligonucleotide
ggaccaaauuaagacggcuuucucccu

SEQ ID NO: 3538 - RNA, 27 nt, Artificial Sequence
  Synthetic oligonucleotide
uggaccaaauuaagacggcuuucuccc

SEQ ID NO: 3539 - RNA, 27 nt, Artificial Sequence
  Synthetic oligonucleotide
cuggaccaaauuaagacggcuuucucc

SEQ ID NO: 3540 - RNA, 27 nt, Artificial Sequence
  Synthetic oligonucleotide
gcuggaccaaauuaagacggcuuucuc

SEQ ID NO: 3541 - RNA, 27 nt, Artificial Sequence
  Synthetic oligonucleotide
cgcuggaccaaauuaagacggcuuucu

SEQ ID NO: 3542 - RNA, 27 nt, Artificial Sequence
  Synthetic oligonucleotide
acgcuggaccaaauuaagacggcuuuc

SEQ ID NO: 3543 - RNA, 27 nt, Artificial Sequence
  Synthetic oligonucleotide
uacgcuggaccaaauuaagacggcuuu

SEQ ID NO: 3544 - RNA, 27 nt, Artificial Sequence
  Synthetic oligonucleotide
uuacgcuggaccaaauuaagacggcuu

SEQ ID NO: 3545 - RNA, 27 nt, Artificial Sequence
  Synthetic oligonucleotide
guuacgcuggaccaaauuaagacggcu

SEQ ID NO: 3546 - RNA, 27 nt, Artificial Sequence
  Synthetic oligonucleotide
cguuacgcuggaccaaauuaagacggc

SEQ ID NO: 3547 - RNA, 27 nt, Artificial Sequence
  Synthetic oligonucleotide
acguuacgcuggaccaaauuaagacgg

SEQ ID NO: 3548 - RNA, 27 nt, Artificial Sequence
  Synthetic oligonucleotide
cacguuacgcuggaccaaauuaagacg

SEQ ID NO: 3549 - RNA, 27 nt, Artificial Sequence
  Synthetic oligonucleotide
ucacguuacgcuggaccaaauuaagac

SEQ ID NO: 3550 - RNA, 27 nt, Artificial Sequence
  Synthetic oligonucleotide
uucacguuacgcuggaccaaauuaaga

SEQ ID NO: 3551 - RNA, 27 nt, Artificial Sequence
  Synthetic oligonucleotide
guucacguuacgcuggaccaaauuaag

SEQ ID NO: 3552 - RNA, 27 nt, Artificial Sequence
  Synthetic oligonucleotide
uguucacguuacgcuggaccaaauuaa

SEQ ID NO: 3553 - RNA, 27 nt, Artificial Sequence
  Synthetic oligonucleotide
auguucacguuacgcuggaccaaauua

SEQ ID NO: 3554 - RNA, 27 nt, Artificial Sequence
  Synthetic oligonucleotide
gauguucacguuacgcuggaccaaauu

SEQ ID NO: 3555 - RNA, 27 nt, Artificial Sequence
  Synthetic oligonucleotide
agauguucacguuacgcuggaccaaau

SEQ ID NO: 3556 - RNA, 27 nt, Artificial Sequence
  Synthetic oligonucleotide
aagauguucacguuacgcuggaccaaa

SEQ ID NO: 3557 - RNA, 27 nt, Artificial Sequence
  Synthetic oligonucleotide
aaagauguucacguuacgcuggaccaa

SEQ ID NO: 3558 - RNA, 27 nt, Artificial Sequence
  Synthetic oligonucleotide
uaaagauguucacguuacgcuggacca

SEQ ID NO: 3559 - RNA, 27 nt, Artificial Sequence
  Synthetic oligonucleotide
uuaaagauguucacguuacgcuggacc

SEQ ID NO: 3560 - RNA, 27 nt, Artificial Sequence
  Synthetic oligonucleotide
uuuaaagauguucacguuacgcuggac

SEQ ID NO: 3561 - RNA, 27 nt, Artificial Sequence
  Synthetic oligonucleotide
auuuaaagauguucacguuacgcugga

SEQ ID NO: 3562 - RNA, 27 nt, Artificial Sequence
  Synthetic oligonucleotide
aauuuaaagauguucacguuacgcugg

SEQ ID NO: 3563 - RNA, 27 nt, Artificial Sequence
  Synthetic oligonucleotide
gaauuuaaagauguucacguuacgcug

SEQ ID NO: 3564 - RNA, 27 nt, Artificial Sequence
  Synthetic oligonucleotide
ugaauuuaaagauguucacguuacgcu

SEQ ID NO: 3565 - RNA, 27 nt, Artificial Sequence
  Synthetic oligonucleotide
augaauuuaaagauguucacguuacgc

SEQ ID NO: 3566 - RNA, 27 nt, Artificial Sequence
  Synthetic oligonucleotide
gaugaauuuaaagauguucacguuacg

SEQ ID NO: 3567 - RNA, 27 nt, Artificial Sequence
  Synthetic oligonucleotide
ugaugaauuuaaagauguucacguuac

SEQ ID NO: 3568 - RNA, 27 nt, Artificial Sequence
  Synthetic oligonucleotide
augaugaauuuaaagauguucacguua

SEQ ID NO: 3569 - RNA, 27 nt, Artificial Sequence
  Synthetic oligonucleotide
aaugaugaauuuaaagauguucacguu

SEQ ID NO: 3570 - RNA, 27 nt, Artificial Sequence
  Synthetic oligonucleotide
gaaugaugaauuuaaagauguucacgu

SEQ ID NO: 3571 - RNA, 27 nt, Artificial Sequence
  Synthetic oligonucleotide
ggaaugaugaauuuaaagauguucacg

SEQ ID NO: 3572 - RNA, 27 nt, Artificial Sequence
  Synthetic oligonucleotide
aggaaugaugaauuuaaagauguucac

SEQ ID NO: 3573 - RNA, 27 nt, Artificial Sequence
  Synthetic oligonucleotide
uaggaaugaugaauuuaaagauguuca

SEQ ID NO: 3574 - RNA, 27 nt, Artificial Sequence
  Synthetic oligonucleotide
uuaggaaugaugaauuuaaagauguuc

SEQ ID NO: 3575 - RNA, 27 nt, Artificial Sequence
  Synthetic oligonucleotide
auuaggaaugaugaauuuaaagauguu

SEQ ID NO: 3576 - RNA, 27 nt, Artificial Sequence
  Synthetic oligonucleotide
cauuaggaaugaugaauuuaaagaugu

SEQ ID NO: 3577 - RNA, 27 nt, Artificial Sequence
  Synthetic oligonucleotide
acauuaggaaugaugaauuuaaagaug

SEQ ID NO: 3578 - RNA, 27 nt, Artificial Sequence
  Synthetic oligonucleotide
aacauuaggaaugaugaauuuaaagau

SEQ ID NO: 3579 - RNA, 27 nt, Artificial Sequence
  Synthetic oligonucleotide
caacauuaggaaugaugaauuuaaaga

SEQ ID NO: 3580 - RNA, 27 nt, Artificial Sequence
  Synthetic oligonucleotide
acaacauuaggaaugaugaauuuaaag

SEQ ID NO: 3581 - RNA, 27 nt, Artificial Sequence
  Synthetic oligonucleotide
uacaacauuaggaaugaugaauuuaaa

SEQ ID NO: 3582 - RNA, 27 nt, Artificial Sequence
  Synthetic oligonucleotide
uuacaacauuaggaaugaugaauuuaa

SEQ ID NO: 3583 - RNA, 27 nt, Artificial Sequence
  Synthetic oligonucleotide
uuuacaacauuaggaaugaugaauuua

SEQ ID NO: 3584 - RNA, 27 nt, Artificial Sequence
  Synthetic oligonucleotide
uuuuacaacauuaggaaugaugaauuu

SEQ ID NO: 3585 - RNA, 27 nt, Artificial Sequence
  Synthetic oligonucleotide
auuuuacaacauuaggaaugaugaauu

SEQ ID NO: 3586 - RNA, 27 nt, Artificial Sequence
  Synthetic oligonucleotide
uauuuuacaacauuaggaaugaugaau

SEQ ID NO: 3587 - RNA, 27 nt, Artificial Sequence
  Synthetic oligonucleotide
guauuuuacaacauuaggaaugaugaa

SEQ ID NO: 3588 - RNA, 27 nt, Artificial Sequence
  Synthetic oligonucleotide
uguauuuuacaacauuaggaaugauga

SEQ ID NO: 3589 - RNA, 27 nt, Artificial Sequence
  Synthetic oligonucleotide
cuguauuuuacaacauuaggaaugaug

SEQ ID NO: 3590 - RNA, 27 nt, Artificial Sequence
  Synthetic oligonucleotide
gcuguauuuuacaacauuaggaaugau

SEQ ID NO: 3591 - RNA, 27 nt, Artificial Sequence
  Synthetic oligonucleotide
ggcuguauuuuacaacauuaggaauga

SEQ ID NO: 3592 - RNA, 27 nt, Artificial Sequence
  Synthetic oligonucleotide
gggcuguauuuuacaacauuaggaaug

SEQ ID NO: 3593 - RNA, 27 nt, Artificial Sequence
  Synthetic oligonucleotide
cgggcuguauuuuacaacauuaggaau

SEQ ID NO: 3594 - RNA, 27 nt, Artificial Sequence
  Synthetic oligonucleotide
ucgggcuguauuuuacaacauuaggaa

SEQ ID NO: 3595 - RNA, 27 nt, Artificial Sequence
  Synthetic oligonucleotide
uucgggcuguauuuuacaacauuagga

SEQ ID NO: 3596 - RNA, 27 nt, Artificial Sequence
  Synthetic oligonucleotide
guucgggcuguauuuuacaacauuagg

SEQ ID NO: 3597 - RNA, 27 nt, Artificial Sequence
  Synthetic oligonucleotide
aguucgggcuguauuuuacaacauuag

SEQ ID NO: 3598 - RNA, 27 nt, Artificial Sequence
  Synthetic oligonucleotide
caguucgggcuguauuuuacaacauua

SEQ ID NO: 3599 - RNA, 27 nt, Artificial Sequence
  Synthetic oligonucleotide
gcaguucgggcuguauuuuacaacauu

SEQ ID NO: 3600 - RNA, 27 nt, Artificial Sequence
  Synthetic oligonucleotide
ugcaguucgggcuguauuuuacaacau

SEQ ID NO: 3601 - RNA, 27 nt, Artificial Sequence
  Synthetic oligonucleotide
uugcaguucgggcuguauuuuacaaca

SEQ ID NO: 3602 - RNA, 27 nt, Artificial Sequence
  Synthetic oligonucleotide
cuugcaguucgggcuguauuuuacaac

SEQ ID NO: 3603 - RNA, 27 nt, Artificial Sequence
  Synthetic oligonucleotide
acuugcaguucgggcuguauuuuacaa

SEQ ID NO: 3604 - RNA, 27 nt, Artificial Sequence
  Synthetic oligonucleotide
aacuugcaguucgggcuguauuuuaca

SEQ ID NO: 3605 - RNA, 27 nt, Artificial Sequence
  Synthetic oligonucleotide
caacuugcaguucgggcuguauuuuac

SEQ ID NO: 3606 - RNA, 27 nt, Artificial Sequence
  Synthetic oligonucleotide
gcaacuugcaguucgggcuguauuuua

SEQ ID NO: 3607 - RNA, 27 nt, Artificial Sequence
  Synthetic oligonucleotide
agcaacuugcaguucgggcuguauuuu

SEQ ID NO: 3608 - RNA, 27 nt, Artificial Sequence
  Synthetic oligonucleotide
aagcaacuugcaguucgggcuguauuu

SEQ ID NO: 3609 - RNA, 27 nt, Artificial Sequence
  Synthetic oligonucleotide
uaagcaacuugcaguucgggcuguauu

SEQ ID NO: 3610 - RNA, 27 nt, Artificial Sequence
  Synthetic oligonucleotide
auaagcaacuugcaguucgggcuguau

SEQ ID NO: 3611 - RNA, 27 nt, Artificial Sequence
  Synthetic oligonucleotide
aauaagcaacuugcaguucgggcugua

SEQ ID NO: 3612 - RNA, 27 nt, Artificial Sequence
  Synthetic oligonucleotide
caauaagcaacuugcaguucgggcugu

SEQ ID NO: 3613 - RNA, 27 nt, Artificial Sequence
  Synthetic oligonucleotide
acaauaagcaacuugcaguucgggcug

SEQ ID NO: 3614 - RNA, 27 nt, Artificial Sequence
  Synthetic oligonucleotide
aacaauaagcaacuugcaguucgggcu

SEQ ID NO: 3615 - RNA, 27 nt, Artificial Sequence
  Synthetic oligonucleotide
aaacaauaagcaacuugcaguucgggc

SEQ ID NO: 3616 - RNA, 27 nt, Artificial Sequence
  Synthetic oligonucleotide
gaaacaauaagcaacuugcaguucggg

SEQ ID NO: 3617 - RNA, 27 nt, Artificial Sequence
  Synthetic oligonucleotide
ugaaacaauaagcaacuugcaguucgg

SEQ ID NO: 3618 - RNA, 27 nt, Artificial Sequence
  Synthetic oligonucleotide
uugaaacaauaagcaacuugcaguucg

SEQ ID NO: 3619 - RNA, 27 nt, Artificial Sequence
  Synthetic oligonucleotide
uuugaaacaauaagcaacuugcaguuc

SEQ ID NO: 3620 - RNA, 27 nt, Artificial Sequence
  Synthetic oligonucleotide
auuugaaacaauaagcaacuugcaguu

SEQ ID NO: 3621 - RNA, 27 nt, Artificial Sequence
  Synthetic oligonucleotide
gauuugaaacaauaagcaacuugcagu

SEQ ID NO: 3622 - RNA, 27 nt, Artificial Sequence
  Synthetic oligonucleotide
ggauuugaaacaauaagcaacuugcag

SEQ ID NO: 3623 - RNA, 27 nt, Artificial Sequence
  Synthetic oligonucleotide
uggauuugaaacaauaagcaacuugca

SEQ ID NO: 3624 - RNA, 27 nt, Artificial Sequence
  Synthetic oligonucleotide
cuggauuugaaacaauaagcaacuugc

SEQ ID NO: 3625 - RNA, 27 nt, Artificial Sequence
  Synthetic oligonucleotide
acuggauuugaaacaauaagcaacuug

SEQ ID NO: 3626 - RNA, 27 nt, Artificial Sequence
  Synthetic oligonucleotide
cacuggauuugaaacaauaagcaacuu

SEQ ID NO: 3627 - RNA, 27 nt, Artificial Sequence
  Synthetic oligonucleotide
ccacuggauuugaaacaauaagcaacu

SEQ ID NO: 3628 - RNA, 27 nt, Artificial Sequence
  Synthetic oligonucleotide
uccacuggauuugaaacaauaagcaac

SEQ ID NO: 3629 - RNA, 27 nt, Artificial Sequence
  Synthetic oligonucleotide
auccacuggauuugaaacaauaagcaa

SEQ ID NO: 3630 - RNA, 27 nt, Artificial Sequence
  Synthetic oligonucleotide
uauccacuggauuugaaacaauaagca

SEQ ID NO: 3631 - RNA, 27 nt, Artificial Sequence
  Synthetic oligonucleotide
auauccacuggauuugaaacaauaagc

SEQ ID NO: 3632 - RNA, 27 nt, Artificial Sequence
  Synthetic oligonucleotide
gauauccacuggauuugaaacaauaag

SEQ ID NO: 3633 - RNA, 27 nt, Artificial Sequence
  Synthetic oligonucleotide
agauauccacuggauuugaaacaauaa

SEQ ID NO: 3634 - RNA, 27 nt, Artificial Sequence
  Synthetic oligonucleotide
aagauauccacuggauuugaaacaaua

SEQ ID NO: 3635 - RNA, 27 nt, Artificial Sequence
  Synthetic oligonucleotide
caagauauccacuggauuugaaacaau

SEQ ID NO: 3636 - RNA, 27 nt, Artificial Sequence
  Synthetic oligonucleotide
ucaagauauccacuggauuugaaacaa

SEQ ID NO: 3637 - RNA, 27 nt, Artificial Sequence
  Synthetic oligonucleotide
gucaagauauccacuggauuugaaaca

SEQ ID NO: 3638 - RNA, 27 nt, Artificial Sequence
  Synthetic oligonucleotide
ggucaagauauccacuggauuugaaac

SEQ ID NO: 3639 - RNA, 27 nt, Artificial Sequence
  Synthetic oligonucleotide
aggucaagauauccacuggauuugaaa

SEQ ID NO: 3640 - RNA, 27 nt, Artificial Sequence
  Synthetic oligonucleotide
uaggucaagauauccacuggauuugaa

SEQ ID NO: 3641 - RNA, 27 nt, Artificial Sequence
  Synthetic oligonucleotide
guaggucaagauauccacuggauuuga

SEQ ID NO: 3642 - RNA, 27 nt, Artificial Sequence
  Synthetic oligonucleotide
cguaggucaagauauccacuggauuug

SEQ ID NO: 3643 - RNA, 27 nt, Artificial Sequence
  Synthetic oligonucleotide
acguaggucaagauauccacuggauuu

SEQ ID NO: 3644 - RNA, 27 nt, Artificial Sequence
  Synthetic oligonucleotide
cacguaggucaagauauccacuggauu

SEQ ID NO: 3645 - RNA, 27 nt, Artificial Sequence
  Synthetic oligonucleotide
ccacguaggucaagauauccacuggau

SEQ ID NO: 3646 - RNA, 27 nt, Artificial Sequence
  Synthetic oligonucleotide
gccacguaggucaagauauccacugga

SEQ ID NO: 3647 - RNA, 27 nt, Artificial Sequence
  Synthetic oligonucleotide
agccacguaggucaagauauccacugg

SEQ ID NO: 3648 - RNA, 27 nt, Artificial Sequence
  Synthetic oligonucleotide
caagccacguaggucaagauauccacu

SEQ ID NO: 3649 - RNA, 27 nt, Artificial Sequence
  Synthetic oligonucleotide
ccaagccacguaggucaagauauccac

SEQ ID NO: 3650 - RNA, 27 nt, Artificial Sequence
  Synthetic oligonucleotide
aucuuccaagccacguaggucaagaua

SEQ ID NO: 3651 - RNA, 27 nt, Artificial Sequence
  Synthetic oligonucleotide
acuuaucuuccaagccacguaggucaa

SEQ ID NO: 3652 - RNA, 27 nt, Artificial Sequence
  Synthetic oligonucleotide
cacuuaucuuccaagccacguagguca

SEQ ID NO: 3653 - RNA, 27 nt, Artificial Sequence
  Synthetic oligonucleotide
ccacuuaucuuccaagccacguagguc

SEQ ID NO: 3654 - RNA, 27 nt, Artificial Sequence
  Synthetic oligonucleotide
accacuuaucuuccaagccacguaggu

SEQ ID NO: 3655 - RNA, 27 nt, Artificial Sequence
  Synthetic oligonucleotide
aaccacuuaucuuccaagccacguagg

SEQ ID NO: 3656 - RNA, 27 nt, Artificial Sequence
  Synthetic oligonucleotide
aaaccacuuaucuuccaagccacguag

SEQ ID NO: 3657 - RNA, 27 nt, Artificial Sequence
  Synthetic oligonucleotide
aaaaccacuuaucuuccaagccacgua

SEQ ID NO: 3658 - RNA, 27 nt, Artificial Sequence
  Synthetic oligonucleotide
gaaaaccacuuaucuuccaagccacgu

SEQ ID NO: 3659 - RNA, 27 nt, Artificial Sequence
  Synthetic oligonucleotide
ggaaaaccacuuaucuuccaagccacg

SEQ ID NO: 3660 - RNA, 27 nt, Artificial Sequence
  Synthetic oligonucleotide
gggaaaaccacuuaucuuccaagccac

SEQ ID NO: 3661 - RNA, 27 nt, Artificial Sequence
  Synthetic oligonucleotide
ugggaaaaccacuuaucuuccaagcca

SEQ ID NO: 3662 - RNA, 27 nt, Artificial Sequence
  Synthetic oligonucleotide
uugggaaaaccacuuaucuuccaagcc

SEQ ID NO: 3663 - RNA, 27 nt, Artificial Sequence
  Synthetic oligonucleotide
uuugggaaaaccacuuaucuuccaagc

SEQ ID NO: 3664 - RNA, 27 nt, Artificial Sequence
  Synthetic oligonucleotide
uuuugggaaaaccacuuaucuuccaag

SEQ ID NO: 3665 - RNA, 27 nt, Artificial Sequence
  Synthetic oligonucleotide
gguuuuugggaaaaccacuuaucuucc

SEQ ID NO: 3666 - RNA, 27 nt, Artificial Sequence
  Synthetic oligonucleotide
cgguuuuugggaaaaccacuuaucuuc

SEQ ID NO: 3667 - RNA, 27 nt, Artificial Sequence
  Synthetic oligonucleotide
acgguuuuugggaaaaccacuuaucuu

SEQ ID NO: 3668 - RNA, 27 nt, Artificial Sequence
  Synthetic oligonucleotide
cacgguuuuugggaaaaccacuuaucu

SEQ ID NO: 3669 - RNA, 27 nt, Artificial Sequence
  Synthetic oligonucleotide
acacgguuuuugggaaaaccacuuauc

SEQ ID NO: 3670 - RNA, 27 nt, Artificial Sequence
  Synthetic oligonucleotide
aacacgguuuuugggaaaaccacuuau

SEQ ID NO: 3671 - RNA, 27 nt, Artificial Sequence
  Synthetic oligonucleotide
uaacacgguuuuugggaaaaccacuua

SEQ ID NO: 3672 - RNA, 27 nt, Artificial Sequence
  Synthetic oligonucleotide
auaacacgguuuuugggaaaaccacuu

SEQ ID NO: 3673 - RNA, 27 nt, Artificial Sequence
  Synthetic oligonucleotide
aauaacacgguuuuugggaaaaccacu

SEQ ID NO: 3674 - RNA, 27 nt, Artificial Sequence
  Synthetic oligonucleotide
caauaacacgguuuuugggaaaaccac

SEQ ID NO: 3675 - RNA, 27 nt, Artificial Sequence
  Synthetic oligonucleotide
ccaauaacacgguuuuugggaaaacca

SEQ ID NO: 3676 - RNA, 27 nt, Artificial Sequence
  Synthetic oligonucleotide
uccaauaacacgguuuuugggaaaacc

SEQ ID NO: 3677 - RNA, 27 nt, Artificial Sequence
  Synthetic oligonucleotide
uuccaauaacacgguuuuugggaaaac

SEQ ID NO: 3678 - RNA, 27 nt, Artificial Sequence
  Synthetic oligonucleotide
cuuccaauaacacgguuuuugggaaaa

SEQ ID NO: 3679 - RNA, 27 nt, Artificial Sequence
  Synthetic oligonucleotide
gcuuccaauaacacgguuuuugggaaa

SEQ ID NO: 3680 - RNA, 27 nt, Artificial Sequence
  Synthetic oligonucleotide
cgcuuccaauaacacgguuuuugggaa

SEQ ID NO: 3681 - RNA, 27 nt, Artificial Sequence
  Synthetic oligonucleotide
ccgcuuccaauaacacgguuuuuggga

SEQ ID NO: 3682 - RNA, 27 nt, Artificial Sequence
  Synthetic oligonucleotide
accgcuuccaauaacacgguuuuuggg

SEQ ID NO: 3683 - RNA, 27 nt, Artificial Sequence
  Synthetic oligonucleotide
aaccgcuuccaauaacacgguuuuugg

SEQ ID NO: 3684 - RNA, 27 nt, Artificial Sequence
  Synthetic oligonucleotide
caaccgcuuccaauaacacgguuuuug

SEQ ID NO: 3685 - RNA, 27 nt, Artificial Sequence
  Synthetic oligonucleotide
gcaaccgcuuccaauaacacgguuuuu

SEQ ID NO: 3686 - RNA, 27 nt, Artificial Sequence
  Synthetic oligonucleotide
ugcaaccgcuuccaauaacacgguuuu

SEQ ID NO: 3687 - RNA, 27 nt, Artificial Sequence
  Synthetic oligonucleotide
uugcaaccgcuuccaauaacacgguuu

SEQ ID NO: 3688 - RNA, 27 nt, Artificial Sequence
  Synthetic oligonucleotide
auugcaaccgcuuccaauaacacgguu

SEQ ID NO: 3689 - RNA, 27 nt, Artificial Sequence
  Synthetic oligonucleotide
gauugcaaccgcuuccaauaacacggu

SEQ ID NO: 3690 - RNA, 27 nt, Artificial Sequence
  Synthetic oligonucleotide
agauugcaaccgcuuccaauaacacgg

SEQ ID NO: 3691 - RNA, 27 nt, Artificial Sequence
  Synthetic oligonucleotide
cagauugcaaccgcuuccaauaacacg

SEQ ID NO: 3692 - RNA, 27 nt, Artificial Sequence
  Synthetic oligonucleotide
ccagauugcaaccgcuuccaauaacac

SEQ ID NO: 3693 - RNA, 27 nt, Artificial Sequence
  Synthetic oligonucleotide
uccagauugcaaccgcuuccaauaaca

SEQ ID NO: 3694 - RNA, 27 nt, Artificial Sequence
  Synthetic oligonucleotide
auccagauugcaaccgcuuccaauaac

SEQ ID NO: 3695 - RNA, 27 nt, Artificial Sequence
  Synthetic oligonucleotide
aauccagauugcaaccgcuuccaauaa

SEQ ID NO: 3696 - RNA, 27 nt, Artificial Sequence
  Synthetic oligonucleotide
gaauccagauugcaaccgcuuccaaua

SEQ ID NO: 3697 - RNA, 27 nt, Artificial Sequence
  Synthetic oligonucleotide
ugaauccagauugcaaccgcuuccaau

SEQ ID NO: 3698 - RNA, 27 nt, Artificial Sequence
  Synthetic oligonucleotide
cugaauccagauugcaaccgcuuccaa

SEQ ID NO: 3699 - RNA, 27 nt, Artificial Sequence
  Synthetic oligonucleotide
gcugaauccagauugcaaccgcuucca

SEQ ID NO: 3700 - RNA, 27 nt, Artificial Sequence
  Synthetic oligonucleotide
ggcugaauccagauugcaaccgcuucc

SEQ ID NO: 3701 - RNA, 27 nt, Artificial Sequence
  Synthetic oligonucleotide
gggcugaauccagauugcaaccgcuuc

SEQ ID NO: 3702 - RNA, 27 nt, Artificial Sequence
  Synthetic oligonucleotide
cgggcugaauccagauugcaaccgcuu

SEQ ID NO: 3703 - RNA, 27 nt, Artificial Sequence
  Synthetic oligonucleotide
ucgggcugaauccagauugcaaccgcu

SEQ ID NO: 3704 - RNA, 27 nt, Artificial Sequence
  Synthetic oligonucleotide
aucgggcugaauccagauugcaaccgc

SEQ ID NO: 3705 - RNA, 27 nt, Artificial Sequence
  Synthetic oligonucleotide
aaucgggcugaauccagauugcaaccg

SEQ ID NO: 3706 - RNA, 27 nt, Artificial Sequence
  Synthetic oligonucleotide
gaaucgggcugaauccagauugcaacc

SEQ ID NO: 3707 - RNA, 27 nt, Artificial Sequence
  Synthetic oligonucleotide
ggaaucgggcugaauccagauugcaac

SEQ ID NO: 3708 - RNA, 27 nt, Artificial Sequence
  Synthetic oligonucleotide
cggaaucgggcugaauccagauugcaa

SEQ ID NO: 3709 - RNA, 27 nt, Artificial Sequence
  Synthetic oligonucleotide
acggaaucgggcugaauccagauugca

SEQ ID NO: 3710 - RNA, 27 nt, Artificial Sequence
  Synthetic oligonucleotide
aacggaaucgggcugaauccagauugc

SEQ ID NO: 3711 - RNA, 27 nt, Artificial Sequence
  Synthetic oligonucleotide
uaacggaaucgggcugaauccagauug

SEQ ID NO: 3712 - RNA, 27 nt, Artificial Sequence
  Synthetic oligonucleotide
guaacggaaucgggcugaauccagauu

SEQ ID NO: 3713 - RNA, 27 nt, Artificial Sequence
  Synthetic oligonucleotide
gguaacggaaucgggcugaauccagau

SEQ ID NO: 3714 - RNA, 27 nt, Artificial Sequence
  Synthetic oligonucleotide
agguaacggaaucgggcugaauccaga

SEQ ID NO: 3715 - RNA, 27 nt, Artificial Sequence
  Synthetic oligonucleotide
uagguaacggaaucgggcugaauccag

SEQ ID NO: 3716 - RNA, 27 nt, Artificial Sequence
  Synthetic oligonucleotide
uuagguaacggaaucgggcugaaucca

SEQ ID NO: 3717 - RNA, 27 nt, Artificial Sequence
  Synthetic oligonucleotide
auuagguaacggaaucgggcugaaucc

SEQ ID NO: 3718 - RNA, 27 nt, Artificial Sequence
  Synthetic oligonucleotide
cauuagguaacggaaucgggcugaauc

SEQ ID NO: 3719 - RNA, 27 nt, Artificial Sequence
  Synthetic oligonucleotide
ccauuagguaacggaaucgggcugaau

SEQ ID NO: 3720 - RNA, 27 nt, Artificial Sequence
  Synthetic oligonucleotide
cccauuagguaacggaaucgggcugaa

SEQ ID NO: 3721 - RNA, 27 nt, Artificial Sequence
  Synthetic oligonucleotide
ccccauuagguaacggaaucgggcuga

SEQ ID NO: 3722 - RNA, 27 nt, Artificial Sequence
  Synthetic oligonucleotide
cccccauuagguaacggaaucgggcug

SEQ ID NO: 3723 - RNA, 27 nt, Artificial Sequence
  Synthetic oligonucleotide
ucccccauuagguaacggaaucgggcu

SEQ ID NO: 3724 - RNA, 27 nt, Artificial Sequence
  Synthetic oligonucleotide
uucccccauuagguaacggaaucgggc

SEQ ID NO: 3725 - RNA, 27 nt, Artificial Sequence
  Synthetic oligonucleotide
uuucccccauuagguaacggaaucggg

SEQ ID NO: 3726 - RNA, 27 nt, Artificial Sequence
  Synthetic oligonucleotide
cuuucccccauuagguaacggaaucgg

SEQ ID NO: 3727 - RNA, 27 nt, Artificial Sequence
  Synthetic oligonucleotide
ccuuucccccauuagguaacggaaucg

SEQ ID NO: 3728 - RNA, 27 nt, Artificial Sequence
  Synthetic oligonucleotide
gccuuucccccauuagguaacggaauc

SEQ ID NO: 3729 - RNA, 27 nt, Artificial Sequence
  Synthetic oligonucleotide
agccuuucccccauuagguaacggaau

SEQ ID NO: 3730 - RNA, 27 nt, Artificial Sequence
  Synthetic oligonucleotide
cagccuuucccccauuagguaacggaa

SEQ ID NO: 3731 - RNA, 27 nt, Artificial Sequence
  Synthetic oligonucleotide
ccagccuuucccccauuagguaacgga

SEQ ID NO: 3732 - RNA, 27 nt, Artificial Sequence
  Synthetic oligonucleotide
cccagccuuucccccauuagguaacgg

SEQ ID NO: 3733 - RNA, 27 nt, Artificial Sequence
  Synthetic oligonucleotide
ucccagccuuucccccauuagguaacg

SEQ ID NO: 3734 - RNA, 27 nt, Artificial Sequence
  Synthetic oligonucleotide
cucccagccuuucccccauuagguaac

SEQ ID NO: 3735 - RNA, 27 nt, Artificial Sequence
  Synthetic oligonucleotide
acucccagccuuucccccauuagguaa

SEQ ID NO: 3736 - RNA, 27 nt, Artificial Sequence
  Synthetic oligonucleotide
aacucccagccuuucccccauuaggua

SEQ ID NO: 3737 - RNA, 27 nt, Artificial Sequence
  Synthetic oligonucleotide
gaacucccagccuuucccccauuaggu

SEQ ID NO: 3738 - RNA, 27 nt, Artificial Sequence
  Synthetic oligonucleotide
ugaacucccagccuuucccccauuagg

SEQ ID NO: 3739 - RNA, 27 nt, Artificial Sequence
  Synthetic oligonucleotide
gugaacucccagccuuucccccauuag

SEQ ID NO: 3740 - RNA, 27 nt, Artificial Sequence
  Synthetic oligonucleotide
ggugaacucccagccuuucccccauua

SEQ ID NO: 3741 - RNA, 27 nt, Artificial Sequence
  Synthetic oligonucleotide
gggugaacucccagccuuucccccauu

SEQ ID NO: 3742 - RNA, 27 nt, Artificial Sequence
  Synthetic oligonucleotide
ugggugaacucccagccuuucccccau

SEQ ID NO: 3743 - RNA, 27 nt, Artificial Sequence
  Synthetic oligonucleotide
augggugaacucccagccuuuccccca

SEQ ID NO: 3744 - RNA, 27 nt, Artificial Sequence
  Synthetic oligonucleotide
aaugggugaacucccagccuuuccccc

SEQ ID NO: 3745 - RNA, 27 nt, Artificial Sequence
  Synthetic oligonucleotide
uaaugggugaacucccagccuuucccc

SEQ ID NO: 3746 - RNA, 27 nt, Artificial Sequence
  Synthetic oligonucleotide
uuaaugggugaacucccagccuuuccc

SEQ ID NO: 3747 - RNA, 27 nt, Artificial Sequence
  Synthetic oligonucleotide
cuuaaugggugaacucccagccuuucc

SEQ ID NO: 3748 - RNA, 27 nt, Artificial Sequence
  Synthetic oligonucleotide
gcuuaaugggugaacucccagccuuuc

SEQ ID NO: 3749 - RNA, 27 nt, Artificial Sequence
  Synthetic oligonucleotide
agcuuaaugggugaacucccagccuuu

SEQ ID NO: 3750 - RNA, 27 nt, Artificial Sequence
  Synthetic oligonucleotide
cagcuuaaugggugaacucccagccuu

SEQ ID NO: 3751 - RNA, 27 nt, Artificial Sequence
  Synthetic oligonucleotide
acagcuuaaugggugaacucccagccu

SEQ ID NO: 3752 - RNA, 27 nt, Artificial Sequence
  Synthetic oligonucleotide
gacagcuuaaugggugaacucccagcc

SEQ ID NO: 3753 - RNA, 27 nt, Artificial Sequence
  Synthetic oligonucleotide
ugacagcuuaaugggugaacucccagc

SEQ ID NO: 3754 - RNA, 27 nt, Artificial Sequence
  Synthetic oligonucleotide
augacagcuuaaugggugaacucccag

SEQ ID NO: 3755 - RNA, 27 nt, Artificial Sequence
  Synthetic oligonucleotide
caugacagcuuaaugggugaacuccca

SEQ ID NO: 3756 - RNA, 27 nt, Artificial Sequence
  Synthetic oligonucleotide
ccaugacagcuuaaugggugaacuccc

SEQ ID NO: 3757 - RNA, 27 nt, Artificial Sequence
  Synthetic oligonucleotide
cccaugacagcuuaaugggugaacucc

SEQ ID NO: 3758 - RNA, 27 nt, Artificial Sequence
  Synthetic oligonucleotide
acccaugacagcuuaaugggugaacuc

SEQ ID NO: 3759 - RNA, 27 nt, Artificial Sequence
  Synthetic oligonucleotide
cacccaugacagcuuaaugggugaacu

SEQ ID NO: 3760 - RNA, 27 nt, Artificial Sequence
  Synthetic oligonucleotide
ccacccaugacagcuuaaugggugaac

SEQ ID NO: 3761 - RNA, 27 nt, Artificial Sequence
  Synthetic oligonucleotide
cccacccaugacagcuuaaugggugaa

SEQ ID NO: 3762 - RNA, 27 nt, Artificial Sequence
  Synthetic oligonucleotide
acccacccaugacagcuuaauggguga

SEQ ID NO: 3763 - RNA, 27 nt, Artificial Sequence
  Synthetic oligonucleotide
gacccacccaugacagcuuaaugggug

SEQ ID NO: 3764 - RNA, 27 nt, Artificial Sequence
  Synthetic oligonucleotide
ggacccacccaugacagcuuaaugggu

SEQ ID NO: 3765 - RNA, 27 nt, Artificial Sequence
  Synthetic oligonucleotide
aggacccacccaugacagcuuaauggg

SEQ ID NO: 3766 - RNA, 27 nt, Artificial Sequence
  Synthetic oligonucleotide
aaggacccacccaugacagcuuaaugg

SEQ ID NO: 3767 - RNA, 27 nt, Artificial Sequence
  Synthetic oligonucleotide
caaggacccacccaugacagcuuaaug

SEQ ID NO: 3768 - RNA, 27 nt, Artificial Sequence
  Synthetic oligonucleotide
ccaaggacccacccaugacagcuuaau

SEQ ID NO: 3769 - RNA, 27 nt, Artificial Sequence
  Synthetic oligonucleotide
cccaaggacccacccaugacagcuuaa

SEQ ID NO: 3770 - RNA, 27 nt, Artificial Sequence
  Synthetic oligonucleotide
ccccaaggacccacccaugacagcuua

SEQ ID NO: 3771 - RNA, 27 nt, Artificial Sequence
  Synthetic oligonucleotide
uccccaaggacccacccaugacagcuu

SEQ ID NO: 3772 - RNA, 27 nt, Artificial Sequence
  Synthetic oligonucleotide
uuccccaaggacccacccaugacagcu

SEQ ID NO: 3773 - RNA, 27 nt, Artificial Sequence
  Synthetic oligonucleotide
guuccccaaggacccacccaugacagc

SEQ ID NO: 3774 - RNA, 27 nt, Artificial Sequence
  Synthetic oligonucleotide
uguuccccaaggacccacccaugacag

SEQ ID NO: 3775 - RNA, 27 nt, Artificial Sequence
  Synthetic oligonucleotide
auguuccccaaggacccacccaugaca

SEQ ID NO: 3776 - RNA, 27 nt, Artificial Sequence
  Synthetic oligonucleotide
cauguuccccaaggacccacccaugac

SEQ ID NO: 3777 - RNA, 27 nt, Artificial Sequence
  Synthetic oligonucleotide
ccauguuccccaaggacccacccauga

SEQ ID NO: 3778 - RNA, 27 nt, Artificial Sequence
  Synthetic oligonucleotide
uccauguuccccaaggacccacccaug

SEQ ID NO: 3779 - RNA, 27 nt, Artificial Sequence
  Synthetic oligonucleotide
cuccauguuccccaaggacccacccau

SEQ ID NO: 3780 - RNA, 27 nt, Artificial Sequence
  Synthetic oligonucleotide
ucuccauguuccccaaggacccaccca

SEQ ID NO: 3781 - RNA, 27 nt, Artificial Sequence
  Synthetic oligonucleotide
aucuccauguuccccaaggacccaccc

SEQ ID NO: 3782 - RNA, 27 nt, Artificial Sequence
  Synthetic oligonucleotide
aaucuccauguuccccaaggacccacc

SEQ ID NO: 3783 - RNA, 27 nt, Artificial Sequence
  Synthetic oligonucleotide
gaaucuccauguuccccaaggacccac

SEQ ID NO: 3784 - RNA, 27 nt, Artificial Sequence
  Synthetic oligonucleotide
ggaaucuccauguuccccaaggaccca

SEQ ID NO: 3785 - RNA, 27 nt, Artificial Sequence
  Synthetic oligonucleotide
uggaaucuccauguuccccaaggaccc

SEQ ID NO: 3786 - RNA, 27 nt, Artificial Sequence
  Synthetic oligonucleotide
cuggaaucuccauguuccccaaggacc

SEQ ID NO: 3787 - RNA, 27 nt, Artificial Sequence
  Synthetic oligonucleotide
acuggaaucuccauguuccccaaggac

SEQ ID NO: 3788 - RNA, 27 nt, Artificial Sequence
  Synthetic oligonucleotide
cacuggaaucuccauguuccccaagga

SEQ ID NO: 3789 - RNA, 27 nt, Artificial Sequence
  Synthetic oligonucleotide
acacuggaaucuccauguuccccaagg

SEQ ID NO: 3790 - RNA, 27 nt, Artificial Sequence
  Synthetic oligonucleotide
cacacuggaaucuccauguuccccaag

SEQ ID NO: 3791 - RNA, 27 nt, Artificial Sequence
  Synthetic oligonucleotide
gcacacuggaaucuccauguuccccaa

SEQ ID NO: 3792 - RNA, 27 nt, Artificial Sequence
  Synthetic oligonucleotide
ggcacacuggaaucuccauguucccca

SEQ ID NO: 3793 - RNA, 27 nt, Artificial Sequence
  Synthetic oligonucleotide
aggcacacuggaaucuccauguucccc

SEQ ID NO: 3794 - RNA, 27 nt, Artificial Sequence
  Synthetic oligonucleotide
caggcacacuggaaucuccauguuccc

SEQ ID NO: 3795 - RNA, 27 nt, Artificial Sequence
  Synthetic oligonucleotide
acaggcacacuggaaucuccauguucc

SEQ ID NO: 3796 - RNA, 27 nt, Artificial Sequence
  Synthetic oligonucleotide
uacaggcacacuggaaucuccauguuc

SEQ ID NO: 3797 - RNA, 27 nt, Artificial Sequence
  Synthetic oligonucleotide
auacaggcacacuggaaucuccauguu

SEQ ID NO: 3798 - RNA, 27 nt, Artificial Sequence
  Synthetic oligonucleotide
cauacaggcacacuggaaucuccaugu

SEQ ID NO: 3799 - RNA, 27 nt, Artificial Sequence
  Synthetic oligonucleotide
ccauacaggcacacuggaaucuccaug

SEQ ID NO: 3800 - RNA, 27 nt, Artificial Sequence
  Synthetic oligonucleotide
uccauacaggcacacuggaaucuccau

SEQ ID NO: 3801 - RNA, 27 nt, Artificial Sequence
  Synthetic oligonucleotide
cuccauacaggcacacuggaaucucca

SEQ ID NO: 3802 - RNA, 27 nt, Artificial Sequence
  Synthetic oligonucleotide
acuccauacaggcacacuggaaucucc

SEQ ID NO: 3803 - RNA, 27 nt, Artificial Sequence
  Synthetic oligonucleotide
cacuccauacaggcacacuggaaucuc

SEQ ID NO: 3804 - RNA, 27 nt, Artificial Sequence
  Synthetic oligonucleotide
ccacuccauacaggcacacuggaaucu

SEQ ID NO: 3805 - RNA, 27 nt, Artificial Sequence
  Synthetic oligonucleotide
uccacuccauacaggcacacuggaauc

SEQ ID NO: 3806 - RNA, 27 nt, Artificial Sequence
  Synthetic oligonucleotide
uuccacuccauacaggcacacuggaau

SEQ ID NO: 3807 - RNA, 27 nt, Artificial Sequence
  Synthetic oligonucleotide
auuccacuccauacaggcacacuggaa

SEQ ID NO: 3808 - RNA, 27 nt, Artificial Sequence
  Synthetic oligonucleotide
cauuccacuccauacaggcacacugga

SEQ ID NO: 3809 - RNA, 27 nt, Artificial Sequence
  Synthetic oligonucleotide
ucauuccacuccauacaggcacacugg

SEQ ID NO: 3810 - RNA, 27 nt, Artificial Sequence
  Synthetic oligonucleotide
uucauuccacuccauacaggcacacug

SEQ ID NO: 3811 - RNA, 27 nt, Artificial Sequence
  Synthetic oligonucleotide
auucauuccacuccauacaggcacacu

SEQ ID NO: 3812 - RNA, 27 nt, Artificial Sequence
  Synthetic oligonucleotide
cauucauuccacuccauacaggcacac

SEQ ID NO: 3813 - RNA, 27 nt, Artificial Sequence
  Synthetic oligonucleotide
acauucauuccacuccauacaggcaca

SEQ ID NO: 3814 - RNA, 27 nt, Artificial Sequence
  Synthetic oligonucleotide
aacauucauuccacuccauacaggcac

SEQ ID NO: 3815 - RNA, 27 nt, Artificial Sequence
  Synthetic oligonucleotide
agcaacauucauuccacuccauacagg

SEQ ID NO: 3816 - RNA, 27 nt, Artificial Sequence
  Synthetic oligonucleotide
cagcaacauucauuccacuccauacag

SEQ ID NO: 3817 - RNA, 27 nt, Artificial Sequence
  Synthetic oligonucleotide
ccagcaacauucauuccacuccauaca

SEQ ID NO: 3818 - RNA, 27 nt, Artificial Sequence
  Synthetic oligonucleotide
accagcaacauucauuccacuccauac

SEQ ID NO: 3819 - RNA, 27 nt, Artificial Sequence
  Synthetic oligonucleotide
caccagcaacauucauuccacuccaua

SEQ ID NO: 3820 - RNA, 27 nt, Artificial Sequence
  Synthetic oligonucleotide
acaccagcaacauucauuccacuccau

SEQ ID NO: 3821 - RNA, 27 nt, Artificial Sequence
  Synthetic oligonucleotide
gacaccagcaacauucauuccacucca

SEQ ID NO: 3822 - RNA, 27 nt, Artificial Sequence
  Synthetic oligonucleotide
agacaccagcaacauucauuccacucc

SEQ ID NO: 3823 - RNA, 27 nt, Artificial Sequence
  Synthetic oligonucleotide
gagacaccagcaacauucauuccacuc

SEQ ID NO: 3824 - RNA, 27 nt, Artificial Sequence
  Synthetic oligonucleotide
agagacaccagcaacauucauuccacu

SEQ ID NO: 3825 - RNA, 27 nt, Artificial Sequence
  Synthetic oligonucleotide
gagagacaccagcaacauucauuccac

SEQ ID NO: 3826 - RNA, 27 nt, Artificial Sequence
  Synthetic oligonucleotide
agagagacaccagcaacauucauucca

SEQ ID NO: 3827 - RNA, 27 nt, Artificial Sequence
  Synthetic oligonucleotide
cagagagacaccagcaacauucauucc

SEQ ID NO: 3828 - RNA, 27 nt, Artificial Sequence
  Synthetic oligonucleotide
ucagagagacaccagcaacauucauuc

SEQ ID NO: 3829 - RNA, 27 nt, Artificial Sequence
  Synthetic oligonucleotide
cuucagagagacaccagcaacauucau

SEQ ID NO: 3830 - RNA, 27 nt, Artificial Sequence
  Synthetic oligonucleotide
ucuucagagagacaccagcaacauuca

SEQ ID NO: 3831 - RNA, 27 nt, Artificial Sequence
  Synthetic oligonucleotide
gucuucagagagacaccagcaacauuc

SEQ ID NO: 3832 - RNA, 27 nt, Artificial Sequence
  Synthetic oligonucleotide
agucuucagagagacaccagcaacauu

SEQ ID NO: 3833 - RNA, 27 nt, Artificial Sequence
  Synthetic oligonucleotide
gagucuucagagagacaccagcaacau

SEQ ID NO: 3834 - RNA, 27 nt, Artificial Sequence
  Synthetic oligonucleotide
agagucuucagagagacaccagcaaca

SEQ ID NO: 3835 - RNA, 27 nt, Artificial Sequence
  Synthetic oligonucleotide
cagagucuucagagagacaccagcaac

SEQ ID NO: 3836 - RNA, 27 nt, Artificial Sequence
  Synthetic oligonucleotide
gcagagucuucagagagacaccagcaa

SEQ ID NO: 3837 - RNA, 27 nt, Artificial Sequence
  Synthetic oligonucleotide
ugcagagucuucagagagacaccagca

SEQ ID NO: 3838 - RNA, 27 nt, Artificial Sequence
  Synthetic oligonucleotide
gugcagagucuucagagagacaccagc

SEQ ID NO: 3839 - RNA, 27 nt, Artificial Sequence
  Synthetic oligonucleotide
ggugcagagucuucagagagacaccag

SEQ ID NO: 3840 - RNA, 27 nt, Artificial Sequence
  Synthetic oligonucleotide
gggugcagagucuucagagagacacca

SEQ ID NO: 3841 - RNA, 27 nt, Artificial Sequence
  Synthetic oligonucleotide
ugggugcagagucuucagagagacacc

SEQ ID NO: 3842 - RNA, 27 nt, Artificial Sequence
  Synthetic oligonucleotide
cugggugcagagucuucagagagacac

SEQ ID NO: 3843 - RNA, 27 nt, Artificial Sequence
  Synthetic oligonucleotide
ucugggugcagagucuucagagagaca

SEQ ID NO: 3844 - RNA, 27 nt, Artificial Sequence
  Synthetic oligonucleotide
aucugggugcagagucuucagagagac

SEQ ID NO: 3845 - RNA, 27 nt, Artificial Sequence
  Synthetic oligonucleotide
aaucugggugcagagucuucagagaga

SEQ ID NO: 3846 - RNA, 27 nt, Artificial Sequence
  Synthetic oligonucleotide
aaaucugggugcagagucuucagagag

SEQ ID NO: 3847 - RNA, 27 nt, Artificial Sequence
  Synthetic oligonucleotide
uaaaucugggugcagagucuucagaga

SEQ ID NO: 3848 - RNA, 27 nt, Artificial Sequence
  Synthetic oligonucleotide
cuaaaucugggugcagagucuucagag

SEQ ID NO: 3849 - RNA, 27 nt, Artificial Sequence
  Synthetic oligonucleotide
ccuaaaucugggugcagagucuucaga

SEQ ID NO: 3850 - RNA, 27 nt, Artificial Sequence
  Synthetic oligonucleotide
cccuaaaucugggugcagagucuucag

SEQ ID NO: 3851 - RNA, 27 nt, Artificial Sequence
  Synthetic oligonucleotide
ucccuaaaucugggugcagagucuuca

SEQ ID NO: 3852 - RNA, 27 nt, Artificial Sequence
  Synthetic oligonucleotide
gucccuaaaucugggugcagagucuuc

SEQ ID NO: 3853 - RNA, 27 nt, Artificial Sequence
  Synthetic oligonucleotide
agucccuaaaucugggugcagagucuu

SEQ ID NO: 3854 - RNA, 27 nt, Artificial Sequence
  Synthetic oligonucleotide
cagucccuaaaucugggugcagagucu

SEQ ID NO: 3855 - RNA, 27 nt, Artificial Sequence
  Synthetic oligonucleotide
ucagucccuaaaucugggugcagaguc

SEQ ID NO: 3856 - RNA, 27 nt, Artificial Sequence
  Synthetic oligonucleotide
aucagucccuaaaucugggugcagagu

SEQ ID NO: 3857 - RNA, 27 nt, Artificial Sequence
  Synthetic oligonucleotide
uaucagucccuaaaucugggugcagag

SEQ ID NO: 3858 - RNA, 27 nt, Artificial Sequence
  Synthetic oligonucleotide
uuaucagucccuaaaucugggugcaga

SEQ ID NO: 3859 - RNA, 27 nt, Artificial Sequence
  Synthetic oligonucleotide
uuuaucagucccuaaaucugggugcag

SEQ ID NO: 3860 - RNA, 27 nt, Artificial Sequence
  Synthetic oligonucleotide
cuuuaucagucccuaaaucugggugca

SEQ ID NO: 3861 - RNA, 27 nt, Artificial Sequence
  Synthetic oligonucleotide
ucuuuaucagucccuaaaucugggugc

SEQ ID NO: 3862 - RNA, 27 nt, Artificial Sequence
  Synthetic oligonucleotide
aucuuuaucagucccuaaaucugggug

SEQ ID NO: 3863 - RNA, 27 nt, Artificial Sequence
  Synthetic oligonucleotide
uaucuuuaucagucccuaaaucugggu

SEQ ID NO: 3864 - RNA, 27 nt, Artificial Sequence
  Synthetic oligonucleotide
uuaucuuuaucagucccuaaaucuggg

SEQ ID NO: 3865 - RNA, 27 nt, Artificial Sequence
  Synthetic oligonucleotide
cuuaucuuuaucagucccuaaaucugg

SEQ ID NO: 3866 - RNA, 27 nt, Artificial Sequence
  Synthetic oligonucleotide
ccuuaucuuuaucagucccuaaaucug

SEQ ID NO: 3867 - RNA, 27 nt, Artificial Sequence
  Synthetic oligonucleotide
uccuuaucuuuaucagucccuaaaucu

SEQ ID NO: 3868 - RNA, 27 nt, Artificial Sequence
  Synthetic oligonucleotide
uuccuuaucuuuaucagucccuaaauc

SEQ ID NO: 3869 - RNA, 27 nt, Artificial Sequence
  Synthetic oligonucleotide
guuccuuaucuuuaucagucccuaaau

SEQ ID NO: 3870 - RNA, 27 nt, Artificial Sequence
  Synthetic oligonucleotide
uguuccuuaucuuuaucagucccuaaa

SEQ ID NO: 3871 - RNA, 27 nt, Artificial Sequence
  Synthetic oligonucleotide
cuguuccuuaucuuuaucagucccuaa

SEQ ID NO: 3872 - RNA, 27 nt, Artificial Sequence
  Synthetic oligonucleotide
acuguuccuuaucuuuaucagucccua

SEQ ID NO: 3873 - RNA, 27 nt, Artificial Sequence
  Synthetic oligonucleotide
ccacuguuccuuaucuuuaucaguccc

SEQ ID NO: 3874 - RNA, 27 nt, Artificial Sequence
  Synthetic oligonucleotide
uccacuguuccuuaucuuuaucagucc

SEQ ID NO: 3875 - RNA, 27 nt, Artificial Sequence
  Synthetic oligonucleotide
uuccacuguuccuuaucuuuaucaguc

SEQ ID NO: 3876 - RNA, 27 nt, Artificial Sequence
  Synthetic oligonucleotide
uuuccacuguuccuuaucuuuaucagu

SEQ ID NO: 3877 - RNA, 27 nt, Artificial Sequence
  Synthetic oligonucleotide
cuuuccacuguuccuuaucuuuaucag

SEQ ID NO: 3878 - RNA, 27 nt, Artificial Sequence
  Synthetic oligonucleotide
ucuuuccacuguuccuuaucuuuauca

SEQ ID NO: 3879 - RNA, 27 nt, Artificial Sequence
  Synthetic oligonucleotide
cucuuuccacuguuccuuaucuuuauc

SEQ ID NO: 3880 - RNA, 27 nt, Artificial Sequence
  Synthetic oligonucleotide
ccucuuuccacuguuccuuaucuuuau

SEQ ID NO: 3881 - RNA, 27 nt, Artificial Sequence
  Synthetic oligonucleotide
accucuuuccacuguuccuuaucuuua

SEQ ID NO: 3882 - RNA, 27 nt, Artificial Sequence
  Synthetic oligonucleotide
aaccucuuuccacuguuccuuaucuuu

SEQ ID NO: 3883 - RNA, 27 nt, Artificial Sequence
  Synthetic oligonucleotide
gaaccucuuuccacuguuccuuaucuu

SEQ ID NO: 3884 - RNA, 27 nt, Artificial Sequence
  Synthetic oligonucleotide
ugaaccucuuuccacuguuccuuaucu

SEQ ID NO: 3885 - RNA, 27 nt, Artificial Sequence
  Synthetic oligonucleotide
gugaaccucuuuccacuguuccuuauc

SEQ ID NO: 3886 - RNA, 27 nt, Artificial Sequence
  Synthetic oligonucleotide
ugugaaccucuuuccacuguuccuuau

SEQ ID NO: 3887 - RNA, 27 nt, Artificial Sequence
  Synthetic oligonucleotide
uugugaaccucuuuccacuguuccuua

SEQ ID NO: 3888 - RNA, 27 nt, Artificial Sequence
  Synthetic oligonucleotide
cuugugaaccucuuuccacuguuccuu

SEQ ID NO: 3889 - RNA, 27 nt, Artificial Sequence
  Synthetic oligonucleotide
gcuugugaaccucuuuccacuguuccu

SEQ ID NO: 3890 - RNA, 27 nt, Artificial Sequence
  Synthetic oligonucleotide
ugcuugugaaccucuuuccacuguucc

SEQ ID NO: 3891 - RNA, 27 nt, Artificial Sequence
  Synthetic oligonucleotide
cugcuugugaaccucuuuccacuguuc

SEQ ID NO: 3892 - RNA, 27 nt, Artificial Sequence
  Synthetic oligonucleotide
ccugcuugugaaccucuuuccacuguu

SEQ ID NO: 3893 - RNA, 27 nt, Artificial Sequence
  Synthetic oligonucleotide
accugcuugugaaccucuuuccacugu

SEQ ID NO: 3894 - RNA, 27 nt, Artificial Sequence
  Synthetic oligonucleotide
caccugcuugugaaccucuuuccacug

SEQ ID NO: 3895 - RNA, 27 nt, Artificial Sequence
  Synthetic oligonucleotide
ccaccugcuugugaaccucuuuccacu

SEQ ID NO: 3896 - RNA, 27 nt, Artificial Sequence
  Synthetic oligonucleotide
accaccugcuugugaaccucuuuccac

SEQ ID NO: 3897 - RNA, 27 nt, Artificial Sequence
  Synthetic oligonucleotide
aaccaccugcuugugaaccucuuucca

SEQ ID NO: 3898 - RNA, 27 nt, Artificial Sequence
  Synthetic oligonucleotide
caaccaccugcuugugaaccucuuucc

SEQ ID NO: 3899 - RNA, 27 nt, Artificial Sequence
  Synthetic oligonucleotide
ucaaccaccugcuugugaaccucuuuc

SEQ ID NO: 3900 - RNA, 27 nt, Artificial Sequence
  Synthetic oligonucleotide
cucaaccaccugcuugugaaccucuuu

SEQ ID NO: 3901 - RNA, 27 nt, Artificial Sequence
  Synthetic oligonucleotide
ucucaaccaccugcuugugaaccucuu

SEQ ID NO: 3902 - RNA, 27 nt, Artificial Sequence
  Synthetic oligonucleotide
cucucaaccaccugcuugugaaccucu

SEQ ID NO: 3903 - RNA, 27 nt, Artificial Sequence
  Synthetic oligonucleotide
acucucaaccaccugcuugugaaccuc

SEQ ID NO: 3904 - RNA, 27 nt, Artificial Sequence
  Synthetic oligonucleotide
cacucucaaccaccugcuugugaaccu

SEQ ID NO: 3905 - RNA, 27 nt, Artificial Sequence
  Synthetic oligonucleotide
gcacucucaaccaccugcuugugaacc

SEQ ID NO: 3906 - RNA, 27 nt, Artificial Sequence
  Synthetic oligonucleotide
agcacucucaaccaccugcuugugaac

SEQ ID NO: 3907 - RNA, 27 nt, Artificial Sequence
  Synthetic oligonucleotide
aagcacucucaaccaccugcuugugaa

SEQ ID NO: 3908 - RNA, 27 nt, Artificial Sequence
  Synthetic oligonucleotide
uaagcacucucaaccaccugcuuguga

SEQ ID NO: 3909 - RNA, 27 nt, Artificial Sequence
  Synthetic oligonucleotide
auaagcacucucaaccaccugcuugug

SEQ ID NO: 3910 - RNA, 27 nt, Artificial Sequence
  Synthetic oligonucleotide
cauaagcacucucaaccaccugcuugu

SEQ ID NO: 3911 - RNA, 27 nt, Artificial Sequence
  Synthetic oligonucleotide
ucauaagcacucucaaccaccugcuug

SEQ ID NO: 3912 - RNA, 27 nt, Artificial Sequence
  Synthetic oligonucleotide
cucauaagcacucucaaccaccugcuu

SEQ ID NO: 3913 - RNA, 27 nt, Artificial Sequence
  Synthetic oligonucleotide
ccucauaagcacucucaaccaccugcu

SEQ ID NO: 3914 - RNA, 27 nt, Artificial Sequence
  Synthetic oligonucleotide
accucauaagcacucucaaccaccugc

SEQ ID NO: 3915 - RNA, 27 nt, Artificial Sequence
  Synthetic oligonucleotide
caccucauaagcacucucaaccaccug

SEQ ID NO: 3916 - RNA, 27 nt, Artificial Sequence
  Synthetic oligonucleotide
ucaccucauaagcacucucaaccaccu

SEQ ID NO: 3917 - RNA, 27 nt, Artificial Sequence
  Synthetic oligonucleotide
aucaccucauaagcacucucaaccacc

SEQ ID NO: 3918 - RNA, 27 nt, Artificial Sequence
  Synthetic oligonucleotide
gaucaccucauaagcacucucaaccac

SEQ ID NO: 3919 - RNA, 27 nt, Artificial Sequence
  Synthetic oligonucleotide
ugaucaccucauaagcacucucaacca

SEQ ID NO: 3920 - RNA, 27 nt, Artificial Sequence
  Synthetic oligonucleotide
uugaucaccucauaagcacucucaacc

SEQ ID NO: 3921 - RNA, 27 nt, Artificial Sequence
  Synthetic oligonucleotide
uuugaucaccucauaagcacucucaac

SEQ ID NO: 3922 - RNA, 27 nt, Artificial Sequence
  Synthetic oligonucleotide
guuugaucaccucauaagcacucucaa

SEQ ID NO: 3923 - RNA, 27 nt, Artificial Sequence
  Synthetic oligonucleotide
aguuugaucaccucauaagcacucuca

SEQ ID NO: 3924 - RNA, 27 nt, Artificial Sequence
  Synthetic oligonucleotide
gaguuugaucaccucauaagcacucuc

SEQ ID NO: 3925 - RNA, 27 nt, Artificial Sequence
  Synthetic oligonucleotide
ugaguuugaucaccucauaagcacucu

SEQ ID NO: 3926 - RNA, 27 nt, Artificial Sequence
  Synthetic oligonucleotide
uugaguuugaucaccucauaagcacuc

SEQ ID NO: 3927 - RNA, 27 nt, Artificial Sequence
  Synthetic oligonucleotide
uuugaguuugaucaccucauaagcacu

SEQ ID NO: 3928 - RNA, 27 nt, Artificial Sequence
  Synthetic oligonucleotide
cuuugaguuugaucaccucauaagcac

SEQ ID NO: 3929 - RNA, 27 nt, Artificial Sequence
  Synthetic oligonucleotide
ccuuugaguuugaucaccucauaagca

SEQ ID NO: 3930 - RNA, 27 nt, Artificial Sequence
  Synthetic oligonucleotide
gccuuugaguuugaucaccucauaagc

SEQ ID NO: 3931 - RNA, 27 nt, Artificial Sequence
  Synthetic oligonucleotide
agccuuugaguuugaucaccucauaag

SEQ ID NO: 3932 - RNA, 27 nt, Artificial Sequence
  Synthetic oligonucleotide
uagccuuugaguuugaucaccucauaa

SEQ ID NO: 3933 - RNA, 27 nt, Artificial Sequence
  Synthetic oligonucleotide
guagccuuugaguuugaucaccucaua

SEQ ID NO: 3934 - RNA, 27 nt, Artificial Sequence
  Synthetic oligonucleotide
uguagccuuugaguuugaucaccucau

SEQ ID NO: 3935 - RNA, 27 nt, Artificial Sequence
  Synthetic oligonucleotide
guguagccuuugaguuugaucaccuca

SEQ ID NO: 3936 - RNA, 27 nt, Artificial Sequence
  Synthetic oligonucleotide
uguguagccuuugaguuugaucaccuc

SEQ ID NO: 3937 - RNA, 27 nt, Artificial Sequence
  Synthetic oligonucleotide
auguguagccuuugaguuugaucaccu

SEQ ID NO: 3938 - RNA, 27 nt, Artificial Sequence
  Synthetic oligonucleotide
gauguguagccuuugaguuugaucacc

SEQ ID NO: 3939 - RNA, 27 nt, Artificial Sequence
  Synthetic oligonucleotide
ggauguguagccuuugaguuugaucac

SEQ ID NO: 3940 - RNA, 27 nt, Artificial Sequence
  Synthetic oligonucleotide
aggauguguagccuuugaguuugauca

SEQ ID NO: 3941 - RNA, 27 nt, Artificial Sequence
  Synthetic oligonucleotide
caggauguguagccuuugaguuugauc

SEQ ID NO: 3942 - RNA, 27 nt, Artificial Sequence
  Synthetic oligonucleotide
ccaggauguguagccuuugaguuugau

SEQ ID NO: 3943 - RNA, 27 nt, Artificial Sequence
  Synthetic oligonucleotide
cccaggauguguagccuuugaguuuga

SEQ ID NO: 3944 - RNA, 27 nt, Artificial Sequence
  Synthetic oligonucleotide
gcccaggauguguagccuuugaguuug

SEQ ID NO: 3945 - RNA, 27 nt, Artificial Sequence
  Synthetic oligonucleotide
agcccaggauguguagccuuugaguuu

SEQ ID NO: 3946 - RNA, 27 nt, Artificial Sequence
  Synthetic oligonucleotide
uagcccaggauguguagccuuugaguu

SEQ ID NO: 3947 - RNA, 27 nt, Artificial Sequence
  Synthetic oligonucleotide
auagcccaggauguguagccuuugagu

SEQ ID NO: 3948 - RNA, 27 nt, Artificial Sequence
  Synthetic oligonucleotide
aauagcccaggauguguagccuuugag

SEQ ID NO: 3949 - RNA, 27 nt, Artificial Sequence
  Synthetic oligonucleotide
caauagcccaggauguguagccuuuga

SEQ ID NO: 3950 - RNA, 27 nt, Artificial Sequence
  Synthetic oligonucleotide
ccaauagcccaggauguguagccuuug

SEQ ID NO: 3951 - RNA, 27 nt, Artificial Sequence
  Synthetic oligonucleotide
uccaauagcccaggauguguagccuuu

SEQ ID NO: 3952 - RNA, 27 nt, Artificial Sequence
  Synthetic oligonucleotide
guccaauagcccaggauguguagccuu

SEQ ID NO: 3953 - RNA, 27 nt, Artificial Sequence
  Synthetic oligonucleotide
aguccaauagcccaggauguguagccu

SEQ ID NO: 3954 - RNA, 27 nt, Artificial Sequence
  Synthetic oligonucleotide
gaguccaauagcccaggauguguagcc

SEQ ID NO: 3955 - RNA, 27 nt, Artificial Sequence
  Synthetic oligonucleotide
agaguccaauagcccaggauguguagc

SEQ ID NO: 3956 - RNA, 27 nt, Artificial Sequence
  Synthetic oligonucleotide
gagaguccaauagcccaggauguguag

SEQ ID NO: 3957 - RNA, 27 nt, Artificial Sequence
  Synthetic oligonucleotide
agagaguccaauagcccaggaugugua

SEQ ID NO: 3958 - RNA, 27 nt, Artificial Sequence
  Synthetic oligonucleotide
cagagaguccaauagcccaggaugugu

SEQ ID NO: 3959 - RNA, 27 nt, Artificial Sequence
  Synthetic oligonucleotide
acagagaguccaauagcccaggaugug

SEQ ID NO: 3960 - RNA, 27 nt, Artificial Sequence
  Synthetic oligonucleotide
uacagagaguccaauagcccaggaugu

SEQ ID NO: 3961 - RNA, 27 nt, Artificial Sequence
  Synthetic oligonucleotide
cuacagagaguccaauagcccaggaug

SEQ ID NO: 3962 - RNA, 27 nt, Artificial Sequence
  Synthetic oligonucleotide
gcuacagagaguccaauagcccaggau

SEQ ID NO: 3963 - RNA, 27 nt, Artificial Sequence
  Synthetic oligonucleotide
ugcuacagagaguccaauagcccagga

SEQ ID NO: 3964 - RNA, 27 nt, Artificial Sequence
  Synthetic oligonucleotide
cugcuacagagaguccaauagcccagg

SEQ ID NO: 3965 - RNA, 27 nt, Artificial Sequence
  Synthetic oligonucleotide
ucugcuacagagaguccaauagcccag

SEQ ID NO: 3966 - RNA, 27 nt, Artificial Sequence
  Synthetic oligonucleotide
aucugcuacagagaguccaauagccca

SEQ ID NO: 3967 - RNA, 27 nt, Artificial Sequence
  Synthetic oligonucleotide
aaucugcuacagagaguccaauagccc

SEQ ID NO: 3968 - RNA, 27 nt, Artificial Sequence
  Synthetic oligonucleotide
aaaucugcuacagagaguccaauagcc

SEQ ID NO: 3969 - RNA, 27 nt, Artificial Sequence
  Synthetic oligonucleotide
caaaucugcuacagagaguccaauagc

SEQ ID NO: 3970 - RNA, 27 nt, Artificial Sequence
  Synthetic oligonucleotide
ccaaaucugcuacagagaguccaauag

SEQ ID NO: 3971 - RNA, 27 nt, Artificial Sequence
  Synthetic oligonucleotide
gccaaaucugcuacagagaguccaaua

SEQ ID NO: 3972 - RNA, 27 nt, Artificial Sequence
  Synthetic oligonucleotide
ugccaaaucugcuacagagaguccaau

SEQ ID NO: 3973 - RNA, 27 nt, Artificial Sequence
  Synthetic oligonucleotide
cugccaaaucugcuacagagaguccaa

SEQ ID NO: 3974 - RNA, 27 nt, Artificial Sequence
  Synthetic oligonucleotide
ucugccaaaucugcuacagagagucca

SEQ ID NO: 3975 - RNA, 27 nt, Artificial Sequence
  Synthetic oligonucleotide
cucugccaaaucugcuacagagagucc

SEQ ID NO: 3976 - RNA, 27 nt, Artificial Sequence
  Synthetic oligonucleotide
ucucugccaaaucugcuacagagaguc

SEQ ID NO: 3977 - RNA, 27 nt, Artificial Sequence
  Synthetic oligonucleotide
cucucugccaaaucugcuacagagagu

SEQ ID NO: 3978 - RNA, 27 nt, Artificial Sequence
  Synthetic oligonucleotide
acucucugccaaaucugcuacagagag

SEQ ID NO: 3979 - RNA, 27 nt, Artificial Sequence
  Synthetic oligonucleotide
uacucucugccaaaucugcuacagaga

SEQ ID NO: 3980 - RNA, 27 nt, Artificial Sequence
  Synthetic oligonucleotide
auacucucugccaaaucugcuacagag

SEQ ID NO: 3981 - RNA, 27 nt, Artificial Sequence
  Synthetic oligonucleotide
uauacucucugccaaaucugcuacaga

SEQ ID NO: 3982 - RNA, 27 nt, Artificial Sequence
  Synthetic oligonucleotide
uuauacucucugccaaaucugcuacag

SEQ ID NO: 3983 - RNA, 27 nt, Artificial Sequence
  Synthetic oligonucleotide
auuauacucucugccaaaucugcuaca

SEQ ID NO: 3984 - RNA, 27 nt, Artificial Sequence
  Synthetic oligonucleotide
cauuauacucucugccaaaucugcuac

SEQ ID NO: 3985 - RNA, 27 nt, Artificial Sequence
  Synthetic oligonucleotide
ucauuauacucucugccaaaucugcua

SEQ ID NO: 3986 - RNA, 27 nt, Artificial Sequence
  Synthetic oligonucleotide
uucauuauacucucugccaaaucugcu

SEQ ID NO: 3987 - RNA, 27 nt, Artificial Sequence
  Synthetic oligonucleotide
cuucauuauacucucugccaaaucugc

SEQ ID NO: 3988 - RNA, 27 nt, Artificial Sequence
  Synthetic oligonucleotide
ucuucauuauacucucugccaaaucug

SEQ ID NO: 3989 - RNA, 27 nt, Artificial Sequence
  Synthetic oligonucleotide
uucuucauuauacucucugccaaaucu

SEQ ID NO: 3990 - RNA, 27 nt, Artificial Sequence
  Synthetic oligonucleotide
auucuucauuauacucucugccaaauc

SEQ ID NO: 3991 - RNA, 27 nt, Artificial Sequence
  Synthetic oligonucleotide
gauucuucauuauacucucugccaaau

SEQ ID NO: 3992 - RNA, 27 nt, Artificial Sequence
  Synthetic oligonucleotide
agauucuucauuauacucucugccaaa

SEQ ID NO: 3993 - RNA, 27 nt, Artificial Sequence
  Synthetic oligonucleotide
aagauucuucauuauacucucugccaa

SEQ ID NO: 3994 - RNA, 27 nt, Artificial Sequence
  Synthetic oligonucleotide
uaagauucuucauuauacucucugcca

SEQ ID NO: 3995 - RNA, 27 nt, Artificial Sequence
  Synthetic oligonucleotide
cuaagauucuucauuauacucucugcc

SEQ ID NO: 3996 - RNA, 27 nt, Artificial Sequence
  Synthetic oligonucleotide
ccuaagauucuucauuauacucucugc

SEQ ID NO: 3997 - RNA, 27 nt, Artificial Sequence
  Synthetic oligonucleotide
gccuaagauucuucauuauacucucug

SEQ ID NO: 3998 - RNA, 27 nt, Artificial Sequence
  Synthetic oligonucleotide
cgccuaagauucuucauuauacucucu

SEQ ID NO: 3999 - RNA, 27 nt, Artificial Sequence
  Synthetic oligonucleotide
ccgccuaagauucuucauuauacucuc

SEQ ID NO: 4000 - RNA, 27 nt, Artificial Sequence
  Synthetic oligonucleotide
cccgccuaagauucuucauuauacucu

SEQ ID NO: 4001 - RNA, 27 nt, Artificial Sequence
  Synthetic oligonucleotide
acccgccuaagauucuucauuauacuc

SEQ ID NO: 4002 - RNA, 27 nt, Artificial Sequence
  Synthetic oligonucleotide
cacccgccuaagauucuucauuauacu

SEQ ID NO: 4003 - RNA, 27 nt, Artificial Sequence
  Synthetic oligonucleotide
gcacccgccuaagauucuucauuauac

SEQ ID NO: 4004 - RNA, 27 nt, Artificial Sequence
  Synthetic oligonucleotide
ugcacccgccuaagauucuucauuaua

SEQ ID NO: 4005 - RNA, 27 nt, Artificial Sequence
  Synthetic oligonucleotide
gugcacccgccuaagauucuucauuau

SEQ ID NO: 4006 - RNA, 27 nt, Artificial Sequence
  Synthetic oligonucleotide
ggugcacccgccuaagauucuucauua

SEQ ID NO: 4007 - RNA, 27 nt, Artificial Sequence
  Synthetic oligonucleotide
gggugcacccgccuaagauucuucauu

SEQ ID NO: 4008 - RNA, 27 nt, Artificial Sequence
  Synthetic oligonucleotide
ugggugcacccgccuaagauucuucau

SEQ ID NO: 4009 - RNA, 27 nt, Artificial Sequence
  Synthetic oligonucleotide
cugggugcacccgccuaagauucuuca

SEQ ID NO: 4010 - RNA, 27 nt, Artificial Sequence
  Synthetic oligonucleotide
acugggugcacccgccuaagauucuuc

SEQ ID NO: 4011 - RNA, 27 nt, Artificial Sequence
  Synthetic oligonucleotide
aacugggugcacccgccuaagauucuu

SEQ ID NO: 4012 - RNA, 27 nt, Artificial Sequence
  Synthetic oligonucleotide
aaacugggugcacccgccuaagauucu

SEQ ID NO: 4013 - RNA, 27 nt, Artificial Sequence
  Synthetic oligonucleotide
gaaacugggugcacccgccuaagauuc

SEQ ID NO: 4014 - RNA, 27 nt, Artificial Sequence
  Synthetic oligonucleotide
ggaaacugggugcacccgccuaagauu

SEQ ID NO: 4015 - RNA, 27 nt, Artificial Sequence
  Synthetic oligonucleotide
uggaaacugggugcacccgccuaagau

SEQ ID NO: 4016 - RNA, 27 nt, Artificial Sequence
  Synthetic oligonucleotide
guggaaacugggugcacccgccuaaga

SEQ ID NO: 4017 - RNA, 27 nt, Artificial Sequence
  Synthetic oligonucleotide
gguggaaacugggugcacccgccuaag

SEQ ID NO: 4018 - RNA, 27 nt, Artificial Sequence
  Synthetic oligonucleotide
ugguggaaacugggugcacccgccuaa

SEQ ID NO: 4019 - RNA, 27 nt, Artificial Sequence
  Synthetic oligonucleotide
augguggaaacugggugcacccgccua

SEQ ID NO: 4020 - RNA, 27 nt, Artificial Sequence
  Synthetic oligonucleotide
caugguggaaacugggugcacccgccu

SEQ ID NO: 4021 - RNA, 27 nt, Artificial Sequence
  Synthetic oligonucleotide
ucaugguggaaacugggugcacccgcc

SEQ ID NO: 4022 - RNA, 27 nt, Artificial Sequence
  Synthetic oligonucleotide
aucaugguggaaacugggugcacccgc

SEQ ID NO: 4023 - RNA, 27 nt, Artificial Sequence
  Synthetic oligonucleotide
aaucaugguggaaacugggugcacccg

SEQ ID NO: 4024 - RNA, 27 nt, Artificial Sequence
  Synthetic oligonucleotide
uaaucaugguggaaacugggugcaccc

SEQ ID NO: 4025 - RNA, 27 nt, Artificial Sequence
  Synthetic oligonucleotide
uuaaucaugguggaaacugggugcacc

SEQ ID NO: 4026 - RNA, 27 nt, Artificial Sequence
  Synthetic oligonucleotide
cuuaaucaugguggaaacugggugcac

SEQ ID NO: 4027 - RNA, 27 nt, Artificial Sequence
  Synthetic oligonucleotide
ccuuaaucaugguggaaacugggugca

SEQ ID NO: 4028 - RNA, 27 nt, Artificial Sequence
  Synthetic oligonucleotide
cccuuaaucaugguggaaacugggugc

SEQ ID NO: 4029 - RNA, 27 nt, Artificial Sequence
  Synthetic oligonucleotide
acccuuaaucaugguggaaacugggug

SEQ ID NO: 4030 - RNA, 27 nt, Artificial Sequence
  Synthetic oligonucleotide
gacccuuaaucaugguggaaacugggu

SEQ ID NO: 4031 - RNA, 27 nt, Artificial Sequence
  Synthetic oligonucleotide
agacccuuaaucaugguggaaacuggg

SEQ ID NO: 4032 - RNA, 27 nt, Artificial Sequence
  Synthetic oligonucleotide
aagacccuuaaucaugguggaaacugg

SEQ ID NO: 4033 - RNA, 27 nt, Artificial Sequence
  Synthetic oligonucleotide
aaagacccuuaaucaugguggaaacug

SEQ ID NO: 4034 - RNA, 27 nt, Artificial Sequence
  Synthetic oligonucleotide
uaaagacccuuaaucaugguggaaacu

SEQ ID NO: 4035 - RNA, 27 nt, Artificial Sequence
  Synthetic oligonucleotide
guaaagacccuuaaucaugguggaaac

SEQ ID NO: 4036 - RNA, 27 nt, Artificial Sequence
  Synthetic oligonucleotide
cguaaagacccuuaaucaugguggaaa

SEQ ID NO: 4037 - RNA, 27 nt, Artificial Sequence
  Synthetic oligonucleotide
ccguaaagacccuuaaucaugguggaa

SEQ ID NO: 4038 - RNA, 27 nt, Artificial Sequence
  Synthetic oligonucleotide
uccguaaagacccuuaaucauggugga

SEQ ID NO: 4039 - RNA, 27 nt, Artificial Sequence
  Synthetic oligonucleotide
uuccguaaagacccuuaaucauggugg

SEQ ID NO: 4040 - RNA, 27 nt, Artificial Sequence
  Synthetic oligonucleotide
auuccguaaagacccuuaaucauggug

SEQ ID NO: 4041 - RNA, 27 nt, Artificial Sequence
  Synthetic oligonucleotide
uauuccguaaagacccuuaaucauggu

SEQ ID NO: 4042 - RNA, 27 nt, Artificial Sequence
  Synthetic oligonucleotide
uuauuccguaaagacccuuaaucaugg

SEQ ID NO: 4043 - RNA, 27 nt, Artificial Sequence
  Synthetic oligonucleotide
uuuauuccguaaagacccuuaaucaug

SEQ ID NO: 4044 - RNA, 27 nt, Artificial Sequence
  Synthetic oligonucleotide
cuuuauuccguaaagacccuuaaucau

SEQ ID NO: 4045 - RNA, 27 nt, Artificial Sequence
  Synthetic oligonucleotide
ccuuuauuccguaaagacccuuaauca

SEQ ID NO: 4046 - RNA, 27 nt, Artificial Sequence
  Synthetic oligonucleotide
uccuuuauuccguaaagacccuuaauc

SEQ ID NO: 4047 - RNA, 27 nt, Artificial Sequence
  Synthetic oligonucleotide
auccuuuauuccguaaagacccuuaau

SEQ ID NO: 4048 - RNA, 27 nt, Artificial Sequence
  Synthetic oligonucleotide
cauccuuuauuccguaaagacccuuaa

SEQ ID NO: 4049 - RNA, 27 nt, Artificial Sequence
  Synthetic oligonucleotide
ucauccuuuauuccguaaagacccuua

SEQ ID NO: 4050 - RNA, 27 nt, Artificial Sequence
  Synthetic oligonucleotide
aucauccuuuauuccguaaagacccuu

SEQ ID NO: 4051 - RNA, 27 nt, Artificial Sequence
  Synthetic oligonucleotide
caucauccuuuauuccguaaagacccu

SEQ ID NO: 4052 - RNA, 27 nt, Artificial Sequence
  Synthetic oligonucleotide
acaucauccuuuauuccguaaagaccc

SEQ ID NO: 4053 - RNA, 27 nt, Artificial Sequence
  Synthetic oligonucleotide
gacaucauccuuuauuccguaaagacc

SEQ ID NO: 4054 - RNA, 27 nt, Artificial Sequence
  Synthetic oligonucleotide
agacaucauccuuuauuccguaaagac

SEQ ID NO: 4055 - RNA, 27 nt, Artificial Sequence
  Synthetic oligonucleotide
aagacaucauccuuuauuccguaaaga

SEQ ID NO: 4056 - RNA, 27 nt, Artificial Sequence
  Synthetic oligonucleotide
gaagacaucauccuuuauuccguaaag

SEQ ID NO: 4057 - RNA, 27 nt, Artificial Sequence
  Synthetic oligonucleotide
ggaagacaucauccuuuauuccguaaa

SEQ ID NO: 4058 - RNA, 27 nt, Artificial Sequence
  Synthetic oligonucleotide
aggaagacaucauccuuuauuccguaa

SEQ ID NO: 4059 - RNA, 27 nt, Artificial Sequence
  Synthetic oligonucleotide
aaggaagacaucauccuuuauuccgua

SEQ ID NO: 4060 - RNA, 27 nt, Artificial Sequence
  Synthetic oligonucleotide
uaaggaagacaucauccuuuauuccgu

SEQ ID NO: 4061 - RNA, 27 nt, Artificial Sequence
  Synthetic oligonucleotide
cuaaggaagacaucauccuuuauuccg

SEQ ID NO: 4062 - RNA, 27 nt, Artificial Sequence
  Synthetic oligonucleotide
acuaaggaagacaucauccuuuauucc

SEQ ID NO: 4063 - RNA, 27 nt, Artificial Sequence
  Synthetic oligonucleotide
cacuaaggaagacaucauccuuuauuc

SEQ ID NO: 4064 - RNA, 27 nt, Artificial Sequence
  Synthetic oligonucleotide
acacuaaggaagacaucauccuuuauu

SEQ ID NO: 4065 - RNA, 27 nt, Artificial Sequence
  Synthetic oligonucleotide
aacacuaaggaagacaucauccuuuau

SEQ ID NO: 4066 - RNA, 27 nt, Artificial Sequence
  Synthetic oligonucleotide
gaacacuaaggaagacaucauccuuua

SEQ ID NO: 4067 - RNA, 27 nt, Artificial Sequence
  Synthetic oligonucleotide
ggaacacuaaggaagacaucauccuuu

SEQ ID NO: 4068 - RNA, 27 nt, Artificial Sequence
  Synthetic oligonucleotide
aggaacacuaaggaagacaucauccuu

SEQ ID NO: 4069 - RNA, 27 nt, Artificial Sequence
  Synthetic oligonucleotide
aaggaacacuaaggaagacaucauccu

SEQ ID NO: 4070 - RNA, 27 nt, Artificial Sequence
  Synthetic oligonucleotide
caaggaacacuaaggaagacaucaucc

SEQ ID NO: 4071 - RNA, 27 nt, Artificial Sequence
  Synthetic oligonucleotide
gcaaggaacacuaaggaagacaucauc

SEQ ID NO: 4072 - RNA, 27 nt, Artificial Sequence
  Synthetic oligonucleotide
ugcaaggaacacuaaggaagacaucau

SEQ ID NO: 4073 - RNA, 27 nt, Artificial Sequence
  Synthetic oligonucleotide
augcaaggaacacuaaggaagacauca

SEQ ID NO: 4074 - RNA, 27 nt, Artificial Sequence
  Synthetic oligonucleotide
aaugcaaggaacacuaaggaagacauc

SEQ ID NO: 4075 - RNA, 27 nt, Artificial Sequence
  Synthetic oligonucleotide
aaaugcaaggaacacuaaggaagacau

SEQ ID NO: 4076 - RNA, 27 nt, Artificial Sequence
  Synthetic oligonucleotide
aaaaugcaaggaacacuaaggaagaca

SEQ ID NO: 4077 - RNA, 27 nt, Artificial Sequence
  Synthetic oligonucleotide
caaaaugcaaggaacacuaaggaagac

SEQ ID NO: 4078 - RNA, 27 nt, Artificial Sequence
  Synthetic oligonucleotide
ccaaaaugcaaggaacacuaaggaaga

SEQ ID NO: 4079 - RNA, 27 nt, Artificial Sequence
  Synthetic oligonucleotide
cccaaaaugcaaggaacacuaaggaag

SEQ ID NO: 4080 - RNA, 27 nt, Artificial Sequence
  Synthetic oligonucleotide
ucccaaaaugcaaggaacacuaaggaa

SEQ ID NO: 4081 - RNA, 27 nt, Artificial Sequence
  Synthetic oligonucleotide
gucccaaaaugcaaggaacacuaagga

SEQ ID NO: 4082 - RNA, 27 nt, Artificial Sequence
  Synthetic oligonucleotide
ugucccaaaaugcaaggaacacuaagg

SEQ ID NO: 4083 - RNA, 27 nt, Artificial Sequence
  Synthetic oligonucleotide
cugucccaaaaugcaaggaacacuaag

SEQ ID NO: 4084 - RNA, 27 nt, Artificial Sequence
  Synthetic oligonucleotide
ucugucccaaaaugcaaggaacacuaa

SEQ ID NO: 4085 - RNA, 27 nt, Artificial Sequence
  Synthetic oligonucleotide
uucugucccaaaaugcaaggaacacua

SEQ ID NO: 4086 - RNA, 27 nt, Artificial Sequence
  Synthetic oligonucleotide
auucugucccaaaaugcaaggaacacu

SEQ ID NO: 4087 - RNA, 27 nt, Artificial Sequence
  Synthetic oligonucleotide
cauucugucccaaaaugcaaggaacac

SEQ ID NO: 4088 - RNA, 27 nt, Artificial Sequence
  Synthetic oligonucleotide
ccauucugucccaaaaugcaaggaaca

SEQ ID NO: 4089 - RNA, 27 nt, Artificial Sequence
  Synthetic oligonucleotide
uccauucugucccaaaaugcaaggaac

SEQ ID NO: 4090 - RNA, 27 nt, Artificial Sequence
  Synthetic oligonucleotide
uuccauucugucccaaaaugcaaggaa

SEQ ID NO: 4091 - RNA, 27 nt, Artificial Sequence
  Synthetic oligonucleotide
auuccauucugucccaaaaugcaagga

SEQ ID NO: 4092 - RNA, 27 nt, Artificial Sequence
  Synthetic oligonucleotide
gauuccauucugucccaaaaugcaagg

SEQ ID NO: 4093 - RNA, 27 nt, Artificial Sequence
  Synthetic oligonucleotide
agauuccauucugucccaaaaugcaag

SEQ ID NO: 4094 - RNA, 27 nt, Artificial Sequence
  Synthetic oligonucleotide
gagauuccauucugucccaaaaugcaa

SEQ ID NO: 4095 - RNA, 27 nt, Artificial Sequence
  Synthetic oligonucleotide
ugagauuccauucugucccaaaaugca

SEQ ID NO: 4096 - RNA, 27 nt, Artificial Sequence
  Synthetic oligonucleotide
cugagauuccauucugucccaaaaugc

SEQ ID NO: 4097 - RNA, 27 nt, Artificial Sequence
  Synthetic oligonucleotide
ucugagauuccauucugucccaaaaug

SEQ ID NO: 4098 - RNA, 27 nt, Artificial Sequence
  Synthetic oligonucleotide
gucugagauuccauucugucccaaaau

SEQ ID NO: 4099 - RNA, 27 nt, Artificial Sequence
  Synthetic oligonucleotide
ggucugagauuccauucugucccaaaa

SEQ ID NO: 4100 - RNA, 27 nt, Artificial Sequence
  Synthetic oligonucleotide
aggucugagauuccauucugucccaaa

SEQ ID NO: 4101 - RNA, 27 nt, Artificial Sequence
  Synthetic oligonucleotide
aaggucugagauuccauucugucccaa

SEQ ID NO: 4102 - RNA, 27 nt, Artificial Sequence
  Synthetic oligonucleotide
caaggucugagauuccauucuguccca

SEQ ID NO: 4103 - RNA, 27 nt, Artificial Sequence
  Synthetic oligonucleotide
acaaggucugagauuccauucuguccc

SEQ ID NO: 4104 - RNA, 27 nt, Artificial Sequence
  Synthetic oligonucleotide
cacaaggucugagauuccauucugucc

SEQ ID NO: 4105 - RNA, 27 nt, Artificial Sequence
  Synthetic oligonucleotide
ucacaaggucugagauuccauucuguc

SEQ ID NO: 4106 - RNA, 27 nt, Artificial Sequence
  Synthetic oligonucleotide
uucacaaggucugagauuccauucugu

SEQ ID NO: 4107 - RNA, 27 nt, Artificial Sequence
  Synthetic oligonucleotide
cuucacaaggucugagauuccauucug

SEQ ID NO: 4108 - RNA, 27 nt, Artificial Sequence
  Synthetic oligonucleotide
ccuucacaaggucugagauuccauucu

SEQ ID NO: 4109 - RNA, 27 nt, Artificial Sequence
  Synthetic oligonucleotide
accuucacaaggucugagauuccauuc

SEQ ID NO: 4110 - RNA, 27 nt, Artificial Sequence
  Synthetic oligonucleotide
caccuucacaaggucugagauuccauu

SEQ ID NO: 4111 - RNA, 27 nt, Artificial Sequence
  Synthetic oligonucleotide
ucaccuucacaaggucugagauuccau

SEQ ID NO: 4112 - RNA, 27 nt, Artificial Sequence
  Synthetic oligonucleotide
gucaccuucacaaggucugagauucca

SEQ ID NO: 4113 - RNA, 27 nt, Artificial Sequence
  Synthetic oligonucleotide
agucaccuucacaaggucugagauucc

SEQ ID NO: 4114 - RNA, 27 nt, Artificial Sequence
  Synthetic oligonucleotide
gagucaccuucacaaggucugagauuc

SEQ ID NO: 4115 - RNA, 27 nt, Artificial Sequence
  Synthetic oligonucleotide
agagucaccuucacaaggucugagauu

SEQ ID NO: 4116 - RNA, 27 nt, Artificial Sequence
  Synthetic oligonucleotide
cagagucaccuucacaaggucugagau

SEQ ID NO: 4117 - RNA, 27 nt, Artificial Sequence
  Synthetic oligonucleotide
ucagagucaccuucacaaggucugaga

SEQ ID NO: 4118 - RNA, 27 nt, Artificial Sequence
  Synthetic oligonucleotide
gucagagucaccuucacaaggucugag

SEQ ID NO: 4119 - RNA, 27 nt, Artificial Sequence
  Synthetic oligonucleotide
agucagagucaccuucacaaggucuga

SEQ ID NO: 4120 - RNA, 27 nt, Artificial Sequence
  Synthetic oligonucleotide
aagucagagucaccuucacaaggucug

SEQ ID NO: 4121 - RNA, 27 nt, Artificial Sequence
  Synthetic oligonucleotide
gaagucagagucaccuucacaaggucu

SEQ ID NO: 4122 - RNA, 27 nt, Artificial Sequence
  Synthetic oligonucleotide
agaagucagagucaccuucacaagguc

SEQ ID NO: 4123 - RNA, 27 nt, Artificial Sequence
  Synthetic oligonucleotide
cagaagucagagucaccuucacaaggu

SEQ ID NO: 4124 - RNA, 27 nt, Artificial Sequence
  Synthetic oligonucleotide
ucagaagucagagucaccuucacaagg

SEQ ID NO: 4125 - RNA, 27 nt, Artificial Sequence
  Synthetic oligonucleotide
cucagaagucagagucaccuucacaag

SEQ ID NO: 4126 - RNA, 27 nt, Artificial Sequence
  Synthetic oligonucleotide
ccucagaagucagagucaccuucacaa

SEQ ID NO: 4127 - RNA, 27 nt, Artificial Sequence
  Synthetic oligonucleotide
uccucagaagucagagucaccuucaca

SEQ ID NO: 4128 - RNA, 27 nt, Artificial Sequence
  Synthetic oligonucleotide
uuccucagaagucagagucaccuucac

SEQ ID NO: 4129 - RNA, 27 nt, Artificial Sequence
  Synthetic oligonucleotide
cuuccucagaagucagagucaccuuca

SEQ ID NO: 4130 - RNA, 27 nt, Artificial Sequence
  Synthetic oligonucleotide
ucuuccucagaagucagagucaccuuc

SEQ ID NO: 4131 - RNA, 27 nt, Artificial Sequence
  Synthetic oligonucleotide
cucuuccucagaagucagagucaccuu

SEQ ID NO: 4132 - RNA, 27 nt, Artificial Sequence
  Synthetic oligonucleotide
ccucuuccucagaagucagagucaccu

SEQ ID NO: 4133 - RNA, 27 nt, Artificial Sequence
  Synthetic oligonucleotide
gccucuuccucagaagucagagucacc

SEQ ID NO: 4134 - RNA, 27 nt, Artificial Sequence
  Synthetic oligonucleotide
ggccucuuccucagaagucagagucac

SEQ ID NO: 4135 - RNA, 27 nt, Artificial Sequence
  Synthetic oligonucleotide
gggccucuuccucagaagucagaguca

SEQ ID NO: 4136 - RNA, 27 nt, Artificial Sequence
  Synthetic oligonucleotide
cgggccucuuccucagaagucagaguc

SEQ ID NO: 4137 - RNA, 27 nt, Artificial Sequence
  Synthetic oligonucleotide
acgggccucuuccucagaagucagagu

SEQ ID NO: 4138 - RNA, 27 nt, Artificial Sequence
  Synthetic oligonucleotide
aacgggccucuuccucagaagucagag

SEQ ID NO: 4139 - RNA, 27 nt, Artificial Sequence
  Synthetic oligonucleotide
aaacgggccucuuccucagaagucaga

SEQ ID NO: 4140 - RNA, 27 nt, Artificial Sequence
  Synthetic oligonucleotide
caaacgggccucuuccucagaagucag

SEQ ID NO: 4141 - RNA, 27 nt, Artificial Sequence
  Synthetic oligonucleotide
ucaaacgggccucuuccucagaaguca

SEQ ID NO: 4142 - RNA, 27 nt, Artificial Sequence
  Synthetic oligonucleotide
uucaaacgggccucuuccucagaaguc

SEQ ID NO: 4143 - RNA, 27 nt, Artificial Sequence
  Synthetic oligonucleotide
cuucaaacgggccucuuccucagaagu

SEQ ID NO: 4144 - RNA, 27 nt, Artificial Sequence
  Synthetic oligonucleotide
ucuucaaacgggccucuuccucagaag

SEQ ID NO: 4145 - RNA, 27 nt, Artificial Sequence
  Synthetic oligonucleotide
uucuucaaacgggccucuuccucagaa

SEQ ID NO: 4146 - RNA, 27 nt, Artificial Sequence
  Synthetic oligonucleotide
cuucuucaaacgggccucuuccucaga

SEQ ID NO: 4147 - RNA, 27 nt, Artificial Sequence
  Synthetic oligonucleotide
ucuucuucaaacgggccucuuccucag

SEQ ID NO: 4148 - RNA, 27 nt, Artificial Sequence
  Synthetic oligonucleotide
cucuucuucaaacgggccucuuccuca

SEQ ID NO: 4149 - RNA, 27 nt, Artificial Sequence
  Synthetic oligonucleotide
acucuucuucaaacgggccucuuccuc

SEQ ID NO: 4150 - RNA, 27 nt, Artificial Sequence
  Synthetic oligonucleotide
cacucuucuucaaacgggccucuuccu

SEQ ID NO: 4151 - RNA, 27 nt, Artificial Sequence
  Synthetic oligonucleotide
gcacucuucuucaaacgggccucuucc

SEQ ID NO: 4152 - RNA, 27 nt, Artificial Sequence
  Synthetic oligonucleotide
ugcacucuucuucaaacgggccucuuc

SEQ ID NO: 4153 - RNA, 27 nt, Artificial Sequence
  Synthetic oligonucleotide
cugcacucuucuucaaacgggccucuu

SEQ ID NO: 4154 - RNA, 27 nt, Artificial Sequence
  Synthetic oligonucleotide
ucugcacucuucuucaaacgggccucu

SEQ ID NO: 4155 - RNA, 27 nt, Artificial Sequence
  Synthetic oligonucleotide
aucugcacucuucuucaaacgggccuc

SEQ ID NO: 4156 - RNA, 27 nt, Artificial Sequence
  Synthetic oligonucleotide
uaucugcacucuucuucaaacgggccu

SEQ ID NO: 4157 - RNA, 27 nt, Artificial Sequence
  Synthetic oligonucleotide
guaucugcacucuucuucaaacgggcc

SEQ ID NO: 4158 - RNA, 27 nt, Artificial Sequence
  Synthetic oligonucleotide
uguaucugcacucuucuucaaacgggc

SEQ ID NO: 4159 - RNA, 27 nt, Artificial Sequence
  Synthetic oligonucleotide
guguaucugcacucuucuucaaacggg

SEQ ID NO: 4160 - RNA, 27 nt, Artificial Sequence
  Synthetic oligonucleotide
aguguaucugcacucuucuucaaacgg

SEQ ID NO: 4161 - RNA, 27 nt, Artificial Sequence
  Synthetic oligonucleotide
aaguguaucugcacucuucuucaaacg

SEQ ID NO: 4162 - RNA, 27 nt, Artificial Sequence
  Synthetic oligonucleotide
aaaguguaucugcacucuucuucaaac

SEQ ID NO: 4163 - RNA, 27 nt, Artificial Sequence
  Synthetic oligonucleotide
caaaguguaucugcacucuucuucaaa

SEQ ID NO: 4164 - RNA, 27 nt, Artificial Sequence
  Synthetic oligonucleotide
ccaaaguguaucugcacucuucuucaa

SEQ ID NO: 4165 - RNA, 27 nt, Artificial Sequence
  Synthetic oligonucleotide
cccaaaguguaucugcacucuucuuca

SEQ ID NO: 4166 - RNA, 27 nt, Artificial Sequence
  Synthetic oligonucleotide
ccccaaaguguaucugcacucuucuuc

SEQ ID NO: 4167 - RNA, 27 nt, Artificial Sequence
  Synthetic oligonucleotide
cccccaaaguguaucugcacucuucuu

SEQ ID NO: 4168 - RNA, 27 nt, Artificial Sequence
  Synthetic oligonucleotide
ucccccaaaguguaucugcacucuucu

SEQ ID NO: 4169 - RNA, 27 nt, Artificial Sequence
  Synthetic oligonucleotide
aucccccaaaguguaucugcacucuuc

SEQ ID NO: 4170 - RNA, 27 nt, Artificial Sequence
  Synthetic oligonucleotide
gaucccccaaaguguaucugcacucuu

SEQ ID NO: 4171 - RNA, 27 nt, Artificial Sequence
  Synthetic oligonucleotide
ggaucccccaaaguguaucugcacucu

SEQ ID NO: 4172 - RNA, 27 nt, Artificial Sequence
  Synthetic oligonucleotide
uggaucccccaaaguguaucugcacuc

SEQ ID NO: 4173 - RNA, 27 nt, Artificial Sequence
  Synthetic oligonucleotide
uuggaucccccaaaguguaucugcacu

SEQ ID NO: 4174 - RNA, 27 nt, Artificial Sequence
  Synthetic oligonucleotide
uuuggaucccccaaaguguaucugcac

SEQ ID NO: 4175 - RNA, 27 nt, Artificial Sequence
  Synthetic oligonucleotide
uuuuggaucccccaaaguguaucugca

SEQ ID NO: 4176 - RNA, 27 nt, Artificial Sequence
  Synthetic oligonucleotide
cuuuuggaucccccaaaguguaucugc

SEQ ID NO: 4177 - RNA, 27 nt, Artificial Sequence
  Synthetic oligonucleotide
ccuuuuggaucccccaaaguguaucug

SEQ ID NO: 4178 - RNA, 27 nt, Artificial Sequence
  Synthetic oligonucleotide
uccuuuuggaucccccaaaguguaucu

SEQ ID NO: 4179 - RNA, 27 nt, Artificial Sequence
  Synthetic oligonucleotide
cuccuuuuggaucccccaaaguguauc

SEQ ID NO: 4180 - RNA, 27 nt, Artificial Sequence
  Synthetic oligonucleotide
gcuccuuuuggaucccccaaaguguau

SEQ ID NO: 4181 - RNA, 27 nt, Artificial Sequence
  Synthetic oligonucleotide
agcuccuuuuggaucccccaaagugua

SEQ ID NO: 4182 - RNA, 27 nt, Artificial Sequence
  Synthetic oligonucleotide
cagcuccuuuuggaucccccaaagugu

SEQ ID NO: 4183 - RNA, 27 nt, Artificial Sequence
  Synthetic oligonucleotide
gcagcuccuuuuggaucccccaaagug

SEQ ID NO: 4184 - RNA, 27 nt, Artificial Sequence
  Synthetic oligonucleotide
ugcagcuccuuuuggaucccccaaagu

SEQ ID NO: 4185 - RNA, 27 nt, Artificial Sequence
  Synthetic oligonucleotide
uugcagcuccuuuuggaucccccaaag

SEQ ID NO: 4186 - RNA, 27 nt, Artificial Sequence
  Synthetic oligonucleotide
auugcagcuccuuuuggaucccccaaa

SEQ ID NO: 4187 - RNA, 27 nt, Artificial Sequence
  Synthetic oligonucleotide
aauugcagcuccuuuuggaucccccaa

SEQ ID NO: 4188 - RNA, 27 nt, Artificial Sequence
  Synthetic oligonucleotide
aaauugcagcuccuuuuggauccccca

SEQ ID NO: 4189 - RNA, 27 nt, Artificial Sequence
  Synthetic oligonucleotide
aaaauugcagcuccuuuuggauccccc

SEQ ID NO: 4190 - RNA, 27 nt, Artificial Sequence
  Synthetic oligonucleotide
uaaaauugcagcuccuuuuggaucccc

SEQ ID NO: 4191 - RNA, 27 nt, Artificial Sequence
  Synthetic oligonucleotide
uuaaaauugcagcuccuuuuggauccc

SEQ ID NO: 4192 - RNA, 27 nt, Artificial Sequence
  Synthetic oligonucleotide
uuuaaaauugcagcuccuuuuggaucc

SEQ ID NO: 4193 - RNA, 27 nt, Artificial Sequence
  Synthetic oligonucleotide
cuuuaaaauugcagcuccuuuuggauc

SEQ ID NO: 4194 - RNA, 27 nt, Artificial Sequence
  Synthetic oligonucleotide
acuuuaaaauugcagcuccuuuuggau

SEQ ID NO: 4195 - RNA, 27 nt, Artificial Sequence
  Synthetic oligonucleotide
gacuuuaaaauugcagcuccuuuugga

SEQ ID NO: 4196 - RNA, 27 nt, Artificial Sequence
  Synthetic oligonucleotide
agacuuuaaaauugcagcuccuuuugg

SEQ ID NO: 4197 - RNA, 27 nt, Artificial Sequence
  Synthetic oligonucleotide
aagacuuuaaaauugcagcuccuuuug

SEQ ID NO: 4198 - RNA, 27 nt, Artificial Sequence
  Synthetic oligonucleotide
gaagacuuuaaaauugcagcuccuuuu

SEQ ID NO: 4199 - RNA, 27 nt, Artificial Sequence
  Synthetic oligonucleotide
agaagacuuuaaaauugcagcuccuuu

SEQ ID NO: 4200 - RNA, 27 nt, Artificial Sequence
  Synthetic oligonucleotide
cagaagacuuuaaaauugcagcuccuu

SEQ ID NO: 4201 - RNA, 27 nt, Artificial Sequence
  Synthetic oligonucleotide
ucagaagacuuuaaaauugcagcuccu

SEQ ID NO: 4202 - RNA, 27 nt, Artificial Sequence
  Synthetic oligonucleotide
aucagaagacuuuaaaauugcagcucc

SEQ ID NO: 4203 - RNA, 27 nt, Artificial Sequence
  Synthetic oligonucleotide
caucagaagacuuuaaaauugcagcuc

SEQ ID NO: 4204 - RNA, 27 nt, Artificial Sequence
  Synthetic oligonucleotide
acaucagaagacuuuaaaauugcagcu

SEQ ID NO: 4205 - RNA, 27 nt, Artificial Sequence
  Synthetic oligonucleotide
gacaucagaagacuuuaaaauugcagc

SEQ ID NO: 4206 - RNA, 27 nt, Artificial Sequence
  Synthetic oligonucleotide
uaugacaucagaagacuuuaaaauugc

SEQ ID NO: 4207 - RNA, 27 nt, Artificial Sequence
  Synthetic oligonucleotide
auaugacaucagaagacuuuaaaauug

SEQ ID NO: 4208 - RNA, 27 nt, Artificial Sequence
  Synthetic oligonucleotide
gauaugacaucagaagacuuuaaaauu

SEQ ID NO: 4209 - RNA, 27 nt, Artificial Sequence
  Synthetic oligonucleotide
ugauaugacaucagaagacuuuaaaau

SEQ ID NO: 4210 - RNA, 27 nt, Artificial Sequence
  Synthetic oligonucleotide
gaaaugauaugacaucagaagacuuua

SEQ ID NO: 4211 - RNA, 27 nt, Artificial Sequence
  Synthetic oligonucleotide
ugaaaugauaugacaucagaagacuuu

SEQ ID NO: 4212 - RNA, 27 nt, Artificial Sequence
  Synthetic oligonucleotide
gugaaaugauaugacaucagaagacuu

SEQ ID NO: 4213 - RNA, 27 nt, Artificial Sequence
  Synthetic oligonucleotide
agugaaaugauaugacaucagaagacu

SEQ ID NO: 4214 - RNA, 27 nt, Artificial Sequence
  Synthetic oligonucleotide
cagugaaaugauaugacaucagaagac

SEQ ID NO: 4215 - RNA, 27 nt, Artificial Sequence
  Synthetic oligonucleotide
acagugaaaugauaugacaucagaaga

SEQ ID NO: 4216 - RNA, 27 nt, Artificial Sequence
  Synthetic oligonucleotide
gacagugaaaugauaugacaucagaag

SEQ ID NO: 4217 - RNA, 27 nt, Artificial Sequence
  Synthetic oligonucleotide
agacagugaaaugauaugacaucagaa

SEQ ID NO: 4218 - RNA, 27 nt, Artificial Sequence
  Synthetic oligonucleotide
uagacagugaaaugauaugacaucaga

SEQ ID NO: 4219 - RNA, 27 nt, Artificial Sequence
  Synthetic oligonucleotide
cuagacagugaaaugauaugacaucag

SEQ ID NO: 4220 - RNA, 27 nt, Artificial Sequence
  Synthetic oligonucleotide
ccuagacagugaaaugauaugacauca

SEQ ID NO: 4221 - RNA, 27 nt, Artificial Sequence
  Synthetic oligonucleotide
gccuagacagugaaaugauaugacauc

SEQ ID NO: 4222 - RNA, 27 nt, Artificial Sequence
  Synthetic oligonucleotide
agccuagacagugaaaugauaugacau

SEQ ID NO: 4223 - RNA, 27 nt, Artificial Sequence
  Synthetic oligonucleotide
uagccuagacagugaaaugauaugaca

SEQ ID NO: 4224 - RNA, 27 nt, Artificial Sequence
  Synthetic oligonucleotide
guagccuagacagugaaaugauaugac

SEQ ID NO: 4225 - RNA, 27 nt, Artificial Sequence
  Synthetic oligonucleotide
uguagccuagacagugaaaugauauga

SEQ ID NO: 4226 - RNA, 27 nt, Artificial Sequence
  Synthetic oligonucleotide
uuguagccuagacagugaaaugauaug

SEQ ID NO: 4227 - RNA, 27 nt, Artificial Sequence
  Synthetic oligonucleotide
guuguagccuagacagugaaaugauau

SEQ ID NO: 4228 - RNA, 27 nt, Artificial Sequence
  Synthetic oligonucleotide
uguuguagccuagacagugaaaugaua

SEQ ID NO: 4229 - RNA, 27 nt, Artificial Sequence
  Synthetic oligonucleotide
cuguuguagccuagacagugaaaugau

SEQ ID NO: 4230 - RNA, 27 nt, Artificial Sequence
  Synthetic oligonucleotide
ccuguuguagccuagacagugaaauga

SEQ ID NO: 4231 - RNA, 27 nt, Artificial Sequence
  Synthetic oligonucleotide
uccuguuguagccuagacagugaaaug

SEQ ID NO: 4232 - RNA, 27 nt, Artificial Sequence
  Synthetic oligonucleotide
auccuguuguagccuagacagugaaau

SEQ ID NO: 4233 - RNA, 27 nt, Artificial Sequence
  Synthetic oligonucleotide
aauccuguuguagccuagacagugaaa

SEQ ID NO: 4234 - RNA, 27 nt, Artificial Sequence
  Synthetic oligonucleotide
gaauccuguuguagccuagacagugaa

SEQ ID NO: 4235 - RNA, 27 nt, Artificial Sequence
  Synthetic oligonucleotide
agaauccuguuguagccuagacaguga

SEQ ID NO: 4236 - RNA, 27 nt, Artificial Sequence
  Synthetic oligonucleotide
uagaauccuguuguagccuagacagug

SEQ ID NO: 4237 - RNA, 27 nt, Artificial Sequence
  Synthetic oligonucleotide
cuagaauccuguuguagccuagacagu

SEQ ID NO: 4238 - RNA, 27 nt, Artificial Sequence
  Synthetic oligonucleotide
ccuagaauccuguuguagccuagacag

SEQ ID NO: 4239 - RNA, 27 nt, Artificial Sequence
  Synthetic oligonucleotide
accuagaauccuguuguagccuagaca

SEQ ID NO: 4240 - RNA, 27 nt, Artificial Sequence
  Synthetic oligonucleotide
caccuagaauccuguuguagccuagac

SEQ ID NO: 4241 - RNA, 27 nt, Artificial Sequence
  Synthetic oligonucleotide
ccaccuagaauccuguuguagccuaga

SEQ ID NO: 4242 - RNA, 27 nt, Artificial Sequence
  Synthetic oligonucleotide
uccaccuagaauccuguuguagccuag

SEQ ID NO: 4243 - RNA, 27 nt, Artificial Sequence
  Synthetic oligonucleotide
cuccaccuagaauccuguuguagccua

SEQ ID NO: 4244 - RNA, 27 nt, Artificial Sequence
  Synthetic oligonucleotide
ccuccaccuagaauccuguuguagccu

SEQ ID NO: 4245 - RNA, 27 nt, Artificial Sequence
  Synthetic oligonucleotide
accuccaccuagaauccuguuguagcc

SEQ ID NO: 4246 - RNA, 27 nt, Artificial Sequence
  Synthetic oligonucleotide
aaccuccaccuagaauccuguuguagc

SEQ ID NO: 4247 - RNA, 27 nt, Artificial Sequence
  Synthetic oligonucleotide
caaccuccaccuagaauccuguuguag

SEQ ID NO: 4248 - RNA, 27 nt, Artificial Sequence
  Synthetic oligonucleotide
acaaccuccaccuagaauccuguugua

SEQ ID NO: 4249 - RNA, 27 nt, Artificial Sequence
  Synthetic oligonucleotide
cacaaccuccaccuagaauccuguugu

SEQ ID NO: 4250 - RNA, 27 nt, Artificial Sequence
  Synthetic oligonucleotide
gcacaaccuccaccuagaauccuguug

SEQ ID NO: 4251 - RNA, 27 nt, Artificial Sequence
  Synthetic oligonucleotide
ugcacaaccuccaccuagaauccuguu

SEQ ID NO: 4252 - RNA, 27 nt, Artificial Sequence
  Synthetic oligonucleotide
augcacaaccuccaccuagaauccugu

SEQ ID NO: 4253 - RNA, 27 nt, Artificial Sequence
  Synthetic oligonucleotide
caugcacaaccuccaccuagaauccug

SEQ ID NO: 4254 - RNA, 27 nt, Artificial Sequence
  Synthetic oligonucleotide
acaugcacaaccuccaccuagaauccu

SEQ ID NO: 4255 - RNA, 27 nt, Artificial Sequence
  Synthetic oligonucleotide
aacaugcacaaccuccaccuagaaucc

SEQ ID NO: 4256 - RNA, 27 nt, Artificial Sequence
  Synthetic oligonucleotide
caacaugcacaaccuccaccuagaauc

SEQ ID NO: 4257 - RNA, 27 nt, Artificial Sequence
  Synthetic oligonucleotide
acaacaugcacaaccuccaccuagaau

SEQ ID NO: 4258 - RNA, 27 nt, Artificial Sequence
  Synthetic oligonucleotide
gacaacaugcacaaccuccaccuagaa

SEQ ID NO: 4259 - RNA, 27 nt, Artificial Sequence
  Synthetic oligonucleotide
ggacaacaugcacaaccuccaccuaga

SEQ ID NO: 4260 - RNA, 27 nt, Artificial Sequence
  Synthetic oligonucleotide
aggacaacaugcacaaccuccaccuag

SEQ ID NO: 4261 - RNA, 27 nt, Artificial Sequence
  Synthetic oligonucleotide
aaggacaacaugcacaaccuccaccua

SEQ ID NO: 4262 - RNA, 27 nt, Artificial Sequence
  Synthetic oligonucleotide
aaaggacaacaugcacaaccuccaccu

SEQ ID NO: 4263 - RNA, 27 nt, Artificial Sequence
  Synthetic oligonucleotide
aaaaggacaacaugcacaaccuccacc

SEQ ID NO: 4264 - RNA, 27 nt, Artificial Sequence
  Synthetic oligonucleotide
aaaaaggacaacaugcacaaccuccac

SEQ ID NO: 4265 - RNA, 27 nt, Artificial Sequence
  Synthetic oligonucleotide
uaaaaaggacaacaugcacaaccucca

SEQ ID NO: 4266 - RNA, 27 nt, Artificial Sequence
  Synthetic oligonucleotide
auaaaaaggacaacaugcacaaccucc

SEQ ID NO: 4267 - RNA, 27 nt, Artificial Sequence
  Synthetic oligonucleotide
gauaaaaaggacaacaugcacaaccuc

SEQ ID NO: 4268 - RNA, 27 nt, Artificial Sequence
  Synthetic oligonucleotide
agauaaaaaggacaacaugcacaaccu

SEQ ID NO: 4269 - RNA, 27 nt, Artificial Sequence
  Synthetic oligonucleotide
cagauaaaaaggacaacaugcacaacc

SEQ ID NO: 4270 - RNA, 27 nt, Artificial Sequence
  Synthetic oligonucleotide
ucagauaaaaaggacaacaugcacaac

SEQ ID NO: 4271 - RNA, 27 nt, Artificial Sequence
  Synthetic oligonucleotide
aucagauaaaaaggacaacaugcacaa

SEQ ID NO: 4272 - RNA, 27 nt, Artificial Sequence
  Synthetic oligonucleotide
gaucagauaaaaaggacaacaugcaca

SEQ ID NO: 4273 - RNA, 27 nt, Artificial Sequence
  Synthetic oligonucleotide
agaucagauaaaaaggacaacaugcac

SEQ ID NO: 4274 - RNA, 27 nt, Artificial Sequence
  Synthetic oligonucleotide
aaucacagaucagauaaaaaggacaac

SEQ ID NO: 4275 - RNA, 27 nt, Artificial Sequence
  Synthetic oligonucleotide
gcuuuaaucacagaucagauaaaaagg

SEQ ID NO: 4276 - RNA, 27 nt, Artificial Sequence
  Synthetic oligonucleotide
uacugcuuuaaucacagaucagauaaa

SEQ ID NO: 4277 - RNA, 27 nt, Artificial Sequence
  Synthetic oligonucleotide
uuacugcuuuaaucacagaucagauaa

SEQ ID NO: 4278 - RNA, 27 nt, Artificial Sequence
  Synthetic oligonucleotide
auuacugcuuuaaucacagaucagaua

SEQ ID NO: 4279 - RNA, 27 nt, Artificial Sequence
  Synthetic oligonucleotide
uauuacugcuuuaaucacagaucagau

SEQ ID NO: 4280 - RNA, 27 nt, Artificial Sequence
  Synthetic oligonucleotide
auauuacugcuuuaaucacagaucaga

SEQ ID NO: 4281 - RNA, 27 nt, Artificial Sequence
  Synthetic oligonucleotide
aauauuacugcuuuaaucacagaucag

SEQ ID NO: 4282 - RNA, 27 nt, Artificial Sequence
  Synthetic oligonucleotide
aaauauuacugcuuuaaucacagauca

SEQ ID NO: 4283 - RNA, 27 nt, Artificial Sequence
  Synthetic oligonucleotide
aaaauauuacugcuuuaaucacagauc

SEQ ID NO: 4284 - RNA, 27 nt, Artificial Sequence
  Synthetic oligonucleotide
uaaaauauuacugcuuuaaucacagau

SEQ ID NO: 4285 - RNA, 27 nt, Artificial Sequence
  Synthetic oligonucleotide
uuaaaauauuacugcuuuaaucacaga

SEQ ID NO: 4286 - RNA, 27 nt, Artificial Sequence
  Synthetic oligonucleotide
cuuaaaauauuacugcuuuaaucacag

SEQ ID NO: 4287 - RNA, 27 nt, Artificial Sequence
  Synthetic oligonucleotide
ucuuaaaauauuacugcuuuaaucaca

SEQ ID NO: 4288 - RNA, 27 nt, Artificial Sequence
  Synthetic oligonucleotide
aucuuaaaauauuacugcuuuaaucac

SEQ ID NO: 4289 - RNA, 27 nt, Artificial Sequence
  Synthetic oligonucleotide
caucuuaaaauauuacugcuuuaauca

SEQ ID NO: 4290 - RNA, 27 nt, Artificial Sequence
  Synthetic oligonucleotide
ccaucuuaaaauauuacugcuuuaauc

SEQ ID NO: 4291 - RNA, 27 nt, Artificial Sequence
  Synthetic oligonucleotide
uccaucuuaaaauauuacugcuuuaau

SEQ ID NO: 4292 - RNA, 27 nt, Artificial Sequence
  Synthetic oligonucleotide
guccaucuuaaaauauuacugcuuuaa

SEQ ID NO: 4293 - RNA, 27 nt, Artificial Sequence
  Synthetic oligonucleotide
aguccaucuuaaaauauuacugcuuua

SEQ ID NO: 4294 - RNA, 27 nt, Artificial Sequence
  Synthetic oligonucleotide
caguccaucuuaaaauauuacugcuuu

SEQ ID NO: 4295 - RNA, 27 nt, Artificial Sequence
  Synthetic oligonucleotide
ccaguccaucuuaaaauauuacugcuu

SEQ ID NO: 4296 - RNA, 27 nt, Artificial Sequence
  Synthetic oligonucleotide
ucccaguccaucuuaaaauauuacugc

SEQ ID NO: 4297 - RNA, 27 nt, Artificial Sequence
  Synthetic oligonucleotide
uucccaguccaucuuaaaauauuacug

SEQ ID NO: 4298 - RNA, 27 nt, Artificial Sequence
  Synthetic oligonucleotide
uuucccaguccaucuuaaaauauuacu

SEQ ID NO: 4299 - RNA, 27 nt, Artificial Sequence
  Synthetic oligonucleotide
uuuucccaguccaucuuaaaauauuac

SEQ ID NO: 4300 - RNA, 27 nt, Artificial Sequence
  Synthetic oligonucleotide
uuuuucccaguccaucuuaaaauauua

SEQ ID NO: 4301 - RNA, 27 nt, Artificial Sequence
  Synthetic oligonucleotide
guuuuucccaguccaucuuaaaauauu

SEQ ID NO: 4302 - RNA, 27 nt, Artificial Sequence
  Synthetic oligonucleotide
uguuuuucccaguccaucuuaaaauau

SEQ ID NO: 4303 - RNA, 27 nt, Artificial Sequence
  Synthetic oligonucleotide
auguuuuucccaguccaucuuaaaaua

SEQ ID NO: 4304 - RNA, 27 nt, Artificial Sequence
  Synthetic oligonucleotide
gauguuuuucccaguccaucuuaaaau

SEQ ID NO: 4305 - RNA, 27 nt, Artificial Sequence
  Synthetic oligonucleotide
ugauguuuuucccaguccaucuuaaaa

SEQ ID NO: 4306 - RNA, 27 nt, Artificial Sequence
  Synthetic oligonucleotide
uugauguuuuucccaguccaucuuaaa

SEQ ID NO: 4307 - RNA, 27 nt, Artificial Sequence
  Synthetic oligonucleotide
guugauguuuuucccaguccaucuuaa

SEQ ID NO: 4308 - RNA, 27 nt, Artificial Sequence
  Synthetic oligonucleotide
aguugauguuuuucccaguccaucuua

SEQ ID NO: 4309 - RNA, 27 nt, Artificial Sequence
  Synthetic oligonucleotide
gaguugauguuuuucccaguccaucuu

SEQ ID NO: 4310 - RNA, 27 nt, Artificial Sequence
  Synthetic oligonucleotide
ggaguugauguuuuucccaguccaucu

SEQ ID NO: 4311 - RNA, 27 nt, Artificial Sequence
  Synthetic oligonucleotide
aggaguugauguuuuucccaguccauc

SEQ ID NO: 4312 - RNA, 27 nt, Artificial Sequence
  Synthetic oligonucleotide
caggaguugauguuuuucccaguccau

SEQ ID NO: 4313 - RNA, 27 nt, Artificial Sequence
  Synthetic oligonucleotide
ucaggaguugauguuuuucccagucca

SEQ ID NO: 4314 - RNA, 27 nt, Artificial Sequence
  Synthetic oligonucleotide
uucaggaguugauguuuuucccagucc

SEQ ID NO: 4315 - RNA, 27 nt, Artificial Sequence
  Synthetic oligonucleotide
cuucaggaguugauguuuuucccaguc

SEQ ID NO: 4316 - RNA, 27 nt, Artificial Sequence
  Synthetic oligonucleotide
acuucaggaguugauguuuuucccagu

SEQ ID NO: 4317 - RNA, 27 nt, Artificial Sequence
  Synthetic oligonucleotide
aacuucaggaguugauguuuuucccag

SEQ ID NO: 4318 - RNA, 27 nt, Artificial Sequence
  Synthetic oligonucleotide
uaacuucaggaguugauguuuuuccca

SEQ ID NO: 4319 - RNA, 27 nt, Artificial Sequence
  Synthetic oligonucleotide
cuaacuucaggaguugauguuuuuccc

SEQ ID NO: 4320 - RNA, 27 nt, Artificial Sequence
  Synthetic oligonucleotide
ucuaacuucaggaguugauguuuuucc

SEQ ID NO: 4321 - RNA, 27 nt, Artificial Sequence
  Synthetic oligonucleotide
uucuaacuucaggaguugauguuuuuc

SEQ ID NO: 4322 - RNA, 27 nt, Artificial Sequence
  Synthetic oligonucleotide
uuucuaacuucaggaguugauguuuuu

SEQ ID NO: 4323 - RNA, 27 nt, Artificial Sequence
  Synthetic oligonucleotide
auuucuaacuucaggaguugauguuuu

SEQ ID NO: 4324 - RNA, 27 nt, Artificial Sequence
  Synthetic oligonucleotide
uauuucuaacuucaggaguugauguuu

SEQ ID NO: 4325 - RNA, 27 nt, Artificial Sequence
  Synthetic oligonucleotide
uuauuucuaacuucaggaguugauguu

SEQ ID NO: 4326 - RNA, 27 nt, Artificial Sequence
  Synthetic oligonucleotide
cuuauuucuaacuucaggaguugaugu

SEQ ID NO: 4327 - RNA, 27 nt, Artificial Sequence
  Synthetic oligonucleotide
ucuuauuucuaacuucaggaguugaug

SEQ ID NO: 4328 - RNA, 27 nt, Artificial Sequence
  Synthetic oligonucleotide
uucuuauuucuaacuucaggaguugau

SEQ ID NO: 4329 - RNA, 27 nt, Artificial Sequence
  Synthetic oligonucleotide
ccauucuuauuucuaacuucaggaguu

SEQ ID NO: 4330 - RNA, 27 nt, Artificial Sequence
  Synthetic oligonucleotide
accauucuuauuucuaacuucaggagu

SEQ ID NO: 4331 - RNA, 27 nt, Artificial Sequence
  Synthetic oligonucleotide
aaccauucuuauuucuaacuucaggag

SEQ ID NO: 4332 - RNA, 27 nt, Artificial Sequence
  Synthetic oligonucleotide
aaaccauucuuauuucuaacuucagga

SEQ ID NO: 4333 - RNA, 27 nt, Artificial Sequence
  Synthetic oligonucleotide
caaaccauucuuauuucuaacuucagg

SEQ ID NO: 4334 - RNA, 27 nt, Artificial Sequence
  Synthetic oligonucleotide
acaaaccauucuuauuucuaacuucag

SEQ ID NO: 4335 - RNA, 27 nt, Artificial Sequence
  Synthetic oligonucleotide
uacaaaccauucuuauuucuaacuuca

SEQ ID NO: 4336 - RNA, 27 nt, Artificial Sequence
  Synthetic oligonucleotide
uuacaaaccauucuuauuucuaacuuc

SEQ ID NO: 4337 - RNA, 27 nt, Artificial Sequence
  Synthetic oligonucleotide
uuuacaaaccauucuuauuucuaacuu

SEQ ID NO: 4338 - RNA, 27 nt, Artificial Sequence
  Synthetic oligonucleotide
uuuuacaaaccauucuuauuucuaacu

SEQ ID NO: 4339 - RNA, 27 nt, Artificial Sequence
  Synthetic oligonucleotide
auuuuacaaaccauucuuauuucuaac

SEQ ID NO: 4340 - RNA, 27 nt, Artificial Sequence
  Synthetic oligonucleotide
gauuuuacaaaccauucuuauuucuaa

SEQ ID NO: 4341 - RNA, 27 nt, Artificial Sequence
  Synthetic oligonucleotide
ggauuuuacaaaccauucuuauuucua

SEQ ID NO: 4342 - RNA, 27 nt, Artificial Sequence
  Synthetic oligonucleotide
uggauuuuacaaaccauucuuauuucu

SEQ ID NO: 4343 - RNA, 27 nt, Artificial Sequence
  Synthetic oligonucleotide
guggauuuuacaaaccauucuuauuuc

SEQ ID NO: 4344 - RNA, 27 nt, Artificial Sequence
  Synthetic oligonucleotide
uguggauuuuacaaaccauucuuauuu

SEQ ID NO: 4345 - RNA, 27 nt, Artificial Sequence
  Synthetic oligonucleotide
cuguggauuuuacaaaccauucuuauu

SEQ ID NO: 4346 - RNA, 27 nt, Artificial Sequence
  Synthetic oligonucleotide
gcuguggauuuuacaaaccauucuuau

SEQ ID NO: 4347 - RNA, 27 nt, Artificial Sequence
  Synthetic oligonucleotide
agcuguggauuuuacaaaccauucuua

SEQ ID NO: 4348 - RNA, 27 nt, Artificial Sequence
  Synthetic oligonucleotide
uagcuguggauuuuacaaaccauucuu

SEQ ID NO: 4349 - RNA, 27 nt, Artificial Sequence
  Synthetic oligonucleotide
auagcuguggauuuuacaaaccauucu

SEQ ID NO: 4350 - RNA, 27 nt, Artificial Sequence
  Synthetic oligonucleotide
uauagcuguggauuuuacaaaccauuc

SEQ ID NO: 4351 - RNA, 27 nt, Artificial Sequence
  Synthetic oligonucleotide
auauagcuguggauuuuacaaaccauu

SEQ ID NO: 4352 - RNA, 27 nt, Artificial Sequence
  Synthetic oligonucleotide
gauauagcuguggauuuuacaaaccau

SEQ ID NO: 4353 - RNA, 27 nt, Artificial Sequence
  Synthetic oligonucleotide
ggauauagcuguggauuuuacaaacca

SEQ ID NO: 4354 - RNA, 27 nt, Artificial Sequence
  Synthetic oligonucleotide
aggauauagcuguggauuuuacaaacc

SEQ ID NO: 4355 - RNA, 27 nt, Artificial Sequence
  Synthetic oligonucleotide
caggauauagcuguggauuuuacaaac

SEQ ID NO: 4356 - RNA, 27 nt, Artificial Sequence
  Synthetic oligonucleotide
ucaggauauagcuguggauuuuacaaa

SEQ ID NO: 4357 - RNA, 27 nt, Artificial Sequence
  Synthetic oligonucleotide
aucaggauauagcuguggauuuuacaa

SEQ ID NO: 4358 - RNA, 27 nt, Artificial Sequence
  Synthetic oligonucleotide
caucaggauauagcuguggauuuuaca

SEQ ID NO: 4359 - RNA, 27 nt, Artificial Sequence
  Synthetic oligonucleotide
gcaucaggauauagcuguggauuuuac

SEQ ID NO: 4360 - RNA, 27 nt, Artificial Sequence
  Synthetic oligonucleotide
agcaucaggauauagcuguggauuuua

SEQ ID NO: 4361 - RNA, 27 nt, Artificial Sequence
  Synthetic oligonucleotide
cagcaucaggauauagcuguggauuuu

SEQ ID NO: 4362 - RNA, 27 nt, Artificial Sequence
  Synthetic oligonucleotide
ccagcaucaggauauagcuguggauuu

SEQ ID NO: 4363 - RNA, 27 nt, Artificial Sequence
  Synthetic oligonucleotide
uccagcaucaggauauagcuguggauu

SEQ ID NO: 4364 - RNA, 27 nt, Artificial Sequence
  Synthetic oligonucleotide
auccagcaucaggauauagcuguggau

SEQ ID NO: 4365 - RNA, 27 nt, Artificial Sequence
  Synthetic oligonucleotide
cauccagcaucaggauauagcugugga

SEQ ID NO: 4366 - RNA, 27 nt, Artificial Sequence
  Synthetic oligonucleotide
ccauccagcaucaggauauagcugugg

SEQ ID NO: 4367 - RNA, 27 nt, Artificial Sequence
  Synthetic oligonucleotide
accauccagcaucaggauauagcugug

SEQ ID NO: 4368 - RNA, 27 nt, Artificial Sequence
  Synthetic oligonucleotide
uaccauccagcaucaggauauagcugu

SEQ ID NO: 4369 - RNA, 27 nt, Artificial Sequence
  Synthetic oligonucleotide
auaccauccagcaucaggauauagcug

SEQ ID NO: 4370 - RNA, 27 nt, Artificial Sequence
  Synthetic oligonucleotide
aauaccauccagcaucaggauauagcu

SEQ ID NO: 4371 - RNA, 27 nt, Artificial Sequence
  Synthetic oligonucleotide
uaauaccauccagcaucaggauauagc

SEQ ID NO: 4372 - RNA, 27 nt, Artificial Sequence
  Synthetic oligonucleotide
uuaauaccauccagcaucaggauauag

SEQ ID NO: 4373 - RNA, 27 nt, Artificial Sequence
  Synthetic oligonucleotide
auuaauaccauccagcaucaggauaua

SEQ ID NO: 4374 - RNA, 27 nt, Artificial Sequence
  Synthetic oligonucleotide
gauuaauaccauccagcaucaggauau

SEQ ID NO: 4375 - RNA, 27 nt, Artificial Sequence
  Synthetic oligonucleotide
agauuaauaccauccagcaucaggaua

SEQ ID NO: 4376 - RNA, 27 nt, Artificial Sequence
  Synthetic oligonucleotide
aagauuaauaccauccagcaucaggau

SEQ ID NO: 4377 - RNA, 27 nt, Artificial Sequence
  Synthetic oligonucleotide
caagauuaauaccauccagcaucagga

SEQ ID NO: 4378 - RNA, 27 nt, Artificial Sequence
  Synthetic oligonucleotide
acaagauuaauaccauccagcaucagg

SEQ ID NO: 4379 - RNA, 27 nt, Artificial Sequence
  Synthetic oligonucleotide
cacaagauuaauaccauccagcaucag

SEQ ID NO: 4380 - RNA, 27 nt, Artificial Sequence
  Synthetic oligonucleotide
acacaagauuaauaccauccagcauca

SEQ ID NO: 4381 - RNA, 27 nt, Artificial Sequence
  Synthetic oligonucleotide
uacacaagauuaauaccauccagcauc

SEQ ID NO: 4382 - RNA, 27 nt, Artificial Sequence
  Synthetic oligonucleotide
cuacacaagauuaauaccauccagcau

SEQ ID NO: 4383 - RNA, 27 nt, Artificial Sequence
  Synthetic oligonucleotide
acuacacaagauuaauaccauccagca

SEQ ID NO: 4384 - RNA, 27 nt, Artificial Sequence
  Synthetic oligonucleotide
gacuacacaagauuaauaccauccagc

SEQ ID NO: 4385 - RNA, 27 nt, Artificial Sequence
  Synthetic oligonucleotide
agacuacacaagauuaauaccauccag

SEQ ID NO: 4386 - RNA, 27 nt, Artificial Sequence
  Synthetic oligonucleotide
aagacuacacaagauuaauaccaucca

SEQ ID NO: 4387 - RNA, 27 nt, Artificial Sequence
  Synthetic oligonucleotide
gaagacuacacaagauuaauaccaucc

SEQ ID NO: 4388 - RNA, 27 nt, Artificial Sequence
  Synthetic oligonucleotide
ugaagacuacacaagauuaauaccauc

SEQ ID NO: 4389 - RNA, 27 nt, Artificial Sequence
  Synthetic oligonucleotide
uugaagacuacacaagauuaauaccau

SEQ ID NO: 4390 - RNA, 27 nt, Artificial Sequence
  Synthetic oligonucleotide
guugaagacuacacaagauuaauacca

SEQ ID NO: 4391 - RNA, 27 nt, Artificial Sequence
  Synthetic oligonucleotide
aguugaagacuacacaagauuaauacc

SEQ ID NO: 4392 - RNA, 27 nt, Artificial Sequence
  Synthetic oligonucleotide
caguugaagacuacacaagauuaauac

SEQ ID NO: 4393 - RNA, 27 nt, Artificial Sequence
  Synthetic oligonucleotide
ccaguugaagacuacacaagauuaaua

SEQ ID NO: 4394 - RNA, 27 nt, Artificial Sequence
  Synthetic oligonucleotide
accaguugaagacuacacaagauuaau

SEQ ID NO: 4395 - RNA, 27 nt, Artificial Sequence
  Synthetic oligonucleotide
aaccaguugaagacuacacaagauuaa

SEQ ID NO: 4396 - RNA, 27 nt, Artificial Sequence
  Synthetic oligonucleotide
uaaccaguugaagacuacacaagauua

SEQ ID NO: 4397 - RNA, 27 nt, Artificial Sequence
  Synthetic oligonucleotide
cuaaccaguugaagacuacacaagauu

SEQ ID NO: 4398 - RNA, 27 nt, Artificial Sequence
  Synthetic oligonucleotide
acuaaccaguugaagacuacacaagau

SEQ ID NO: 4399 - RNA, 27 nt, Artificial Sequence
  Synthetic oligonucleotide
cacuaaccaguugaagacuacacaaga

SEQ ID NO: 4400 - RNA, 27 nt, Artificial Sequence
  Synthetic oligonucleotide
acacuaaccaguugaagacuacacaag

SEQ ID NO: 4401 - RNA, 27 nt, Artificial Sequence
  Synthetic oligonucleotide
cacacuaaccaguugaagacuacacaa

SEQ ID NO: 4402 - RNA, 27 nt, Artificial Sequence
  Synthetic oligonucleotide
ucacacuaaccaguugaagacuacaca

SEQ ID NO: 4403 - RNA, 27 nt, Artificial Sequence
  Synthetic oligonucleotide
uucacacuaaccaguugaagacuacac

SEQ ID NO: 4404 - RNA, 27 nt, Artificial Sequence
  Synthetic oligonucleotide
uuucacacuaaccaguugaagacuaca

SEQ ID NO: 4405 - RNA, 27 nt, Artificial Sequence
  Synthetic oligonucleotide
auuucacacuaaccaguugaagacuac

SEQ ID NO: 4406 - RNA, 27 nt, Artificial Sequence
  Synthetic oligonucleotide
uauuucacacuaaccaguugaagacua

SEQ ID NO: 4407 - RNA, 27 nt, Artificial Sequence
  Synthetic oligonucleotide
cuauuucacacuaaccaguugaagacu

SEQ ID NO: 4408 - RNA, 27 nt, Artificial Sequence
  Synthetic oligonucleotide
acuauuucacacuaaccaguugaagac

SEQ ID NO: 4409 - RNA, 27 nt, Artificial Sequence
  Synthetic oligonucleotide
aacuauuucacacuaaccaguugaaga

SEQ ID NO: 4410 - RNA, 27 nt, Artificial Sequence
  Synthetic oligonucleotide
gaacuauuucacacuaaccaguugaag

SEQ ID NO: 4411 - RNA, 27 nt, Artificial Sequence
  Synthetic oligonucleotide
agaacuauuucacacuaaccaguugaa

SEQ ID NO: 4412 - RNA, 27 nt, Artificial Sequence
  Synthetic oligonucleotide
uggcagaacuauuucacacuaaccagu

SEQ ID NO: 4413 - RNA, 27 nt, Artificial Sequence
  Synthetic oligonucleotide
gguggcagaacuauuucacacuaacca

SEQ ID NO: 4414 - RNA, 27 nt, Artificial Sequence
  Synthetic oligonucleotide
agguggcagaacuauuucacacuaacc

SEQ ID NO: 4415 - RNA, 27 nt, Artificial Sequence
  Synthetic oligonucleotide
gagguggcagaacuauuucacacuaac

SEQ ID NO: 4416 - RNA, 27 nt, Artificial Sequence
  Synthetic oligonucleotide
agagguggcagaacuauuucacacuaa

SEQ ID NO: 4417 - RNA, 27 nt, Artificial Sequence
  Synthetic oligonucleotide
cagagguggcagaacuauuucacacua

SEQ ID NO: 4418 - RNA, 27 nt, Artificial Sequence
  Synthetic oligonucleotide
ucagagguggcagaacuauuucacacu

SEQ ID NO: 4419 - RNA, 27 nt, Artificial Sequence
  Synthetic oligonucleotide
gucagagguggcagaacuauuucacac

SEQ ID NO: 4420 - RNA, 27 nt, Artificial Sequence
  Synthetic oligonucleotide
cgucagagguggcagaacuauuucaca

SEQ ID NO: 4421 - RNA, 27 nt, Artificial Sequence
  Synthetic oligonucleotide
gcgucagagguggcagaacuauuucac

SEQ ID NO: 4422 - RNA, 27 nt, Artificial Sequence
  Synthetic oligonucleotide
ugcgucagagguggcagaacuauuuca

SEQ ID NO: 4423 - RNA, 27 nt, Artificial Sequence
  Synthetic oligonucleotide
gugcgucagagguggcagaacuauuuc

SEQ ID NO: 4424 - RNA, 27 nt, Artificial Sequence
  Synthetic oligonucleotide
ggugcgucagagguggcagaacuauuu

SEQ ID NO: 4425 - RNA, 27 nt, Artificial Sequence
  Synthetic oligonucleotide
uggugcgucagagguggcagaacuauu

SEQ ID NO: 4426 - RNA, 27 nt, Artificial Sequence
  Synthetic oligonucleotide
guggugcgucagagguggcagaacuau

SEQ ID NO: 4427 - RNA, 27 nt, Artificial Sequence
  Synthetic oligonucleotide
aguggugcgucagagguggcagaacua

SEQ ID NO: 4428 - RNA, 27 nt, Artificial Sequence
  Synthetic oligonucleotide
caguggugcgucagagguggcagaacu

SEQ ID NO: 4429 - RNA, 27 nt, Artificial Sequence
  Synthetic oligonucleotide
gcaguggugcgucagagguggcagaac

SEQ ID NO: 4430 - RNA, 27 nt, Artificial Sequence
  Synthetic oligonucleotide
ggcaguggugcgucagagguggcagaa

SEQ ID NO: 4431 - RNA, 27 nt, Artificial Sequence
  Synthetic oligonucleotide
uggcaguggugcgucagagguggcaga

SEQ ID NO: 4432 - RNA, 27 nt, Artificial Sequence
  Synthetic oligonucleotide
uuggcaguggugcgucagagguggcag

SEQ ID NO: 4433 - RNA, 27 nt, Artificial Sequence
  Synthetic oligonucleotide
auuggcaguggugcgucagagguggca

SEQ ID NO: 4434 - RNA, 27 nt, Artificial Sequence
  Synthetic oligonucleotide
cauuggcaguggugcgucagagguggc

SEQ ID NO: 4435 - RNA, 27 nt, Artificial Sequence
  Synthetic oligonucleotide
gcauuggcaguggugcgucagaggugg

SEQ ID NO: 4436 - RNA, 27 nt, Artificial Sequence
  Synthetic oligonucleotide
agcauuggcaguggugcgucagaggug

SEQ ID NO: 4437 - RNA, 27 nt, Artificial Sequence
  Synthetic oligonucleotide
cagcauuggcaguggugcgucagaggu

SEQ ID NO: 4438 - RNA, 27 nt, Artificial Sequence
  Synthetic oligonucleotide
acagcauuggcaguggugcgucagagg

SEQ ID NO: 4439 - RNA, 27 nt, Artificial Sequence
  Synthetic oligonucleotide
uacagcauuggcaguggugcgucagag

SEQ ID NO: 4440 - RNA, 27 nt, Artificial Sequence
  Synthetic oligonucleotide
guacagcauuggcaguggugcgucaga

SEQ ID NO: 4441 - RNA, 27 nt, Artificial Sequence
  Synthetic oligonucleotide
cguacagcauuggcaguggugcgucag

SEQ ID NO: 4442 - RNA, 27 nt, Artificial Sequence
  Synthetic oligonucleotide
acguacagcauuggcaguggugcguca

SEQ ID NO: 4443 - RNA, 27 nt, Artificial Sequence
  Synthetic oligonucleotide
uacguacagcauuggcaguggugcguc

SEQ ID NO: 4444 - RNA, 27 nt, Artificial Sequence
  Synthetic oligonucleotide
guacguacagcauuggcaguggugcgu

SEQ ID NO: 4445 - RNA, 27 nt, Artificial Sequence
  Synthetic oligonucleotide
aguacguacagcauuggcaguggugcg

SEQ ID NO: 4446 - RNA, 27 nt, Artificial Sequence
  Synthetic oligonucleotide
caguacguacagcauuggcaguggugc

SEQ ID NO: 4447 - RNA, 27 nt, Artificial Sequence
  Synthetic oligonucleotide
gcaguacguacagcauuggcaguggug

SEQ ID NO: 4448 - RNA, 27 nt, Artificial Sequence
  Synthetic oligonucleotide
ugcaguacguacagcauuggcaguggu

SEQ ID NO: 4449 - RNA, 27 nt, Artificial Sequence
  Synthetic oligonucleotide
augcaguacguacagcauuggcagugg

SEQ ID NO: 4450 - RNA, 27 nt, Artificial Sequence
  Synthetic oligonucleotide
aaugcaguacguacagcauuggcagug

SEQ ID NO: 4451 - RNA, 27 nt, Artificial Sequence
  Synthetic oligonucleotide
aaaugcaguacguacagcauuggcagu

SEQ ID NO: 4452 - RNA, 27 nt, Artificial Sequence
  Synthetic oligonucleotide
caaaugcaguacguacagcauuggcag

SEQ ID NO: 4453 - RNA, 27 nt, Artificial Sequence
  Synthetic oligonucleotide
gcaaaugcaguacguacagcauuggca

SEQ ID NO: 4454 - RNA, 27 nt, Artificial Sequence
  Synthetic oligonucleotide
ggcaaaugcaguacguacagcauuggc

SEQ ID NO: 4455 - RNA, 27 nt, Artificial Sequence
  Synthetic oligonucleotide
gggcaaaugcaguacguacagcauugg

SEQ ID NO: 4456 - RNA, 27 nt, Artificial Sequence
  Synthetic oligonucleotide
ggggcaaaugcaguacguacagcauug

SEQ ID NO: 4457 - RNA, 27 nt, Artificial Sequence
  Synthetic oligonucleotide
aggggcaaaugcaguacguacagcauu

SEQ ID NO: 4458 - RNA, 27 nt, Artificial Sequence
  Synthetic oligonucleotide
aaggggcaaaugcaguacguacagcau

SEQ ID NO: 4459 - RNA, 27 nt, Artificial Sequence
  Synthetic oligonucleotide
caaggggcaaaugcaguacguacagca

SEQ ID NO: 4460 - RNA, 27 nt, Artificial Sequence
  Synthetic oligonucleotide
ucaaggggcaaaugcaguacguacagc

SEQ ID NO: 4461 - RNA, 27 nt, Artificial Sequence
  Synthetic oligonucleotide
cucaaggggcaaaugcaguacguacag

SEQ ID NO: 4462 - RNA, 27 nt, Artificial Sequence
  Synthetic oligonucleotide
gcucaaggggcaaaugcaguacguaca

SEQ ID NO: 4463 - RNA, 27 nt, Artificial Sequence
  Synthetic oligonucleotide
ggcucaaggggcaaaugcaguacguac

SEQ ID NO: 4464 - RNA, 27 nt, Artificial Sequence
  Synthetic oligonucleotide
uggcucaaggggcaaaugcaguacgua

SEQ ID NO: 4465 - RNA, 27 nt, Artificial Sequence
  Synthetic oligonucleotide
cuggcucaaggggcaaaugcaguacgu

SEQ ID NO: 4466 - RNA, 27 nt, Artificial Sequence
  Synthetic oligonucleotide
ccuggcucaaggggcaaaugcaguacg

SEQ ID NO: 4467 - RNA, 27 nt, Artificial Sequence
  Synthetic oligonucleotide
accuggcucaaggggcaaaugcaguac

SEQ ID NO: 4468 - RNA, 27 nt, Artificial Sequence
  Synthetic oligonucleotide
caccuggcucaaggggcaaaugcagua

SEQ ID NO: 4469 - RNA, 27 nt, Artificial Sequence
  Synthetic oligonucleotide
ccaccuggcucaaggggcaaaugcagu

SEQ ID NO: 4470 - RNA, 27 nt, Artificial Sequence
  Synthetic oligonucleotide
uccaccuggcucaaggggcaaaugcag

SEQ ID NO: 4471 - RNA, 27 nt, Artificial Sequence
  Synthetic oligonucleotide
auccaccuggcucaaggggcaaaugca

SEQ ID NO: 4472 - RNA, 27 nt, Artificial Sequence
  Synthetic oligonucleotide
cauccaccuggcucaaggggcaaaugc

SEQ ID NO: 4473 - RNA, 27 nt, Artificial Sequence
  Synthetic oligonucleotide
acauccaccuggcucaaggggcaaaug

SEQ ID NO: 4474 - RNA, 27 nt, Artificial Sequence
  Synthetic oligonucleotide
aacauccaccuggcucaaggggcaaau

SEQ ID NO: 4475 - RNA, 27 nt, Artificial Sequence
  Synthetic oligonucleotide
aaacauccaccuggcucaaggggcaaa

SEQ ID NO: 4476 - RNA, 27 nt, Artificial Sequence
  Synthetic oligonucleotide
uaaacauccaccuggcucaaggggcaa

SEQ ID NO: 4477 - RNA, 27 nt, Artificial Sequence
  Synthetic oligonucleotide
guaaacauccaccuggcucaaggggca

SEQ ID NO: 4478 - RNA, 27 nt, Artificial Sequence
  Synthetic oligonucleotide
gguaaacauccaccuggcucaaggggc

SEQ ID NO: 4479 - RNA, 27 nt, Artificial Sequence
  Synthetic oligonucleotide
cgguaaacauccaccuggcucaagggg

SEQ ID NO: 4480 - RNA, 27 nt, Artificial Sequence
  Synthetic oligonucleotide
acgguaaacauccaccuggcucaaggg

SEQ ID NO: 4481 - RNA, 27 nt, Artificial Sequence
  Synthetic oligonucleotide
cacgguaaacauccaccuggcucaagg

SEQ ID NO: 4482 - RNA, 27 nt, Artificial Sequence
  Synthetic oligonucleotide
acacgguaaacauccaccuggcucaag

SEQ ID NO: 4483 - RNA, 27 nt, Artificial Sequence
  Synthetic oligonucleotide
cacacgguaaacauccaccuggcucaa

SEQ ID NO: 4484 - RNA, 27 nt, Artificial Sequence
  Synthetic oligonucleotide
acacacgguaaacauccaccuggcuca

SEQ ID NO: 4485 - RNA, 27 nt, Artificial Sequence
  Synthetic oligonucleotide
aacacacgguaaacauccaccuggcuc

SEQ ID NO: 4486 - RNA, 27 nt, Artificial Sequence
  Synthetic oligonucleotide
uaacacacgguaaacauccaccuggcu

SEQ ID NO: 4487 - RNA, 27 nt, Artificial Sequence
  Synthetic oligonucleotide
auaacacacgguaaacauccaccuggc

SEQ ID NO: 4488 - RNA, 27 nt, Artificial Sequence
  Synthetic oligonucleotide
uauaacacacgguaaacauccaccugg

SEQ ID NO: 4489 - RNA, 27 nt, Artificial Sequence
  Synthetic oligonucleotide
auauaacacacgguaaacauccaccug

SEQ ID NO: 4490 - RNA, 27 nt, Artificial Sequence
  Synthetic oligonucleotide
uauauaacacacgguaaacauccaccu

SEQ ID NO: 4491 - RNA, 27 nt, Artificial Sequence
  Synthetic oligonucleotide
uuauauaacacacgguaaacauccacc

SEQ ID NO: 4492 - RNA, 27 nt, Artificial Sequence
  Synthetic oligonucleotide
guuauauaacacacgguaaacauccac

SEQ ID NO: 4493 - RNA, 27 nt, Artificial Sequence
  Synthetic oligonucleotide
aguuauauaacacacgguaaacaucca

SEQ ID NO: 4494 - RNA, 27 nt, Artificial Sequence
  Synthetic oligonucleotide
aaguuauauaacacacgguaaacaucc

SEQ ID NO: 4495 - RNA, 27 nt, Artificial Sequence
  Synthetic oligonucleotide
gaaguuauauaacacacgguaaacauc

SEQ ID NO: 4496 - RNA, 27 nt, Artificial Sequence
  Synthetic oligonucleotide
ggaaguuauauaacacacgguaaacau

SEQ ID NO: 4497 - RNA, 27 nt, Artificial Sequence
  Synthetic oligonucleotide
aggaaguuauauaacacacgguaaaca

SEQ ID NO: 4498 - RNA, 27 nt, Artificial Sequence
  Synthetic oligonucleotide
caggaaguuauauaacacacgguaaac

SEQ ID NO: 4499 - RNA, 27 nt, Artificial Sequence
  Synthetic oligonucleotide
ccaggaaguuauauaacacacgguaaa

SEQ ID NO: 4500 - RNA, 27 nt, Artificial Sequence
  Synthetic oligonucleotide
gccaggaaguuauauaacacacgguaa

SEQ ID NO: 4501 - RNA, 27 nt, Artificial Sequence
  Synthetic oligonucleotide
agccaggaaguuauauaacacacggua

SEQ ID NO: 4502 - RNA, 27 nt, Artificial Sequence
  Synthetic oligonucleotide
gagccaggaaguuauauaacacacggu

SEQ ID NO: 4503 - RNA, 27 nt, Artificial Sequence
  Synthetic oligonucleotide
ggagccaggaaguuauauaacacacgg

SEQ ID NO: 4504 - RNA, 27 nt, Artificial Sequence
  Synthetic oligonucleotide
aggagccaggaaguuauauaacacacg

SEQ ID NO: 4505 - RNA, 27 nt, Artificial Sequence
  Synthetic oligonucleotide
aaggagccaggaaguuauauaacacac

SEQ ID NO: 4506 - RNA, 27 nt, Artificial Sequence
  Synthetic oligonucleotide
gaaggagccaggaaguuauauaacaca

SEQ ID NO: 4507 - RNA, 27 nt, Artificial Sequence
  Synthetic oligonucleotide
ugaaggagccaggaaguuauauaacac

SEQ ID NO: 4508 - RNA, 27 nt, Artificial Sequence
  Synthetic oligonucleotide
gugaaggagccaggaaguuauauaaca

SEQ ID NO: 4509 - RNA, 27 nt, Artificial Sequence
  Synthetic oligonucleotide
agugaaggagccaggaaguuauauaac

SEQ ID NO: 4510 - RNA, 27 nt, Artificial Sequence
  Synthetic oligonucleotide
cagugaaggagccaggaaguuauauaa

SEQ ID NO: 4511 - RNA, 27 nt, Artificial Sequence
  Synthetic oligonucleotide
ucagugaaggagccaggaaguuauaua

SEQ ID NO: 4512 - RNA, 27 nt, Artificial Sequence
  Synthetic oligonucleotide
uucagugaaggagccaggaaguuauau

SEQ ID NO: 4513 - RNA, 27 nt, Artificial Sequence
  Synthetic oligonucleotide
guucagugaaggagccaggaaguuaua

SEQ ID NO: 4514 - RNA, 27 nt, Artificial Sequence
  Synthetic oligonucleotide
uguucagugaaggagccaggaaguuau

SEQ ID NO: 4515 - RNA, 27 nt, Artificial Sequence
  Synthetic oligonucleotide
auguucagugaaggagccaggaaguua

SEQ ID NO: 4516 - RNA, 27 nt, Artificial Sequence
  Synthetic oligonucleotide
cauguucagugaaggagccaggaaguu

SEQ ID NO: 4517 - RNA, 27 nt, Artificial Sequence
  Synthetic oligonucleotide
gcauguucagugaaggagccaggaagu

SEQ ID NO: 4518 - RNA, 27 nt, Artificial Sequence
  Synthetic oligonucleotide
ggcauguucagugaaggagccaggaag

SEQ ID NO: 4519 - RNA, 27 nt, Artificial Sequence
  Synthetic oligonucleotide
aggcauguucagugaaggagccaggaa

SEQ ID NO: 4520 - RNA, 27 nt, Artificial Sequence
  Synthetic oligonucleotide
uaggcauguucagugaaggagccagga

SEQ ID NO: 4521 - RNA, 27 nt, Artificial Sequence
  Synthetic oligonucleotide
cuaggcauguucagugaaggagccagg

SEQ ID NO: 4522 - RNA, 27 nt, Artificial Sequence
  Synthetic oligonucleotide
acuaggcauguucagugaaggagccag

SEQ ID NO: 4523 - RNA, 27 nt, Artificial Sequence
  Synthetic oligonucleotide
gacuaggcauguucagugaaggagcca

SEQ ID NO: 4524 - RNA, 27 nt, Artificial Sequence
  Synthetic oligonucleotide
ggacuaggcauguucagugaaggagcc

SEQ ID NO: 4525 - RNA, 27 nt, Artificial Sequence
  Synthetic oligonucleotide
uggacuaggcauguucagugaaggagc

SEQ ID NO: 4526 - RNA, 27 nt, Artificial Sequence
  Synthetic oligonucleotide
uuggacuaggcauguucagugaaggag

SEQ ID NO: 4527 - RNA, 27 nt, Artificial Sequence
  Synthetic oligonucleotide
guuggacuaggcauguucagugaagga

SEQ ID NO: 4528 - RNA, 27 nt, Artificial Sequence
  Synthetic oligonucleotide
uguuggacuaggcauguucagugaagg

SEQ ID NO: 4529 - RNA, 27 nt, Artificial Sequence
  Synthetic oligonucleotide
auguuggacuaggcauguucagugaag

SEQ ID NO: 4530 - RNA, 27 nt, Artificial Sequence
  Synthetic oligonucleotide
aauguuggacuaggcauguucagugaa

SEQ ID NO: 4531 - RNA, 27 nt, Artificial Sequence
  Synthetic oligonucleotide
aaauguuggacuaggcauguucaguga

SEQ ID NO: 4532 - RNA, 27 nt, Artificial Sequence
  Synthetic oligonucleotide
aaaauguuggacuaggcauguucagug

SEQ ID NO: 4533 - RNA, 27 nt, Artificial Sequence
  Synthetic oligonucleotide
aaaaauguuggacuaggcauguucagu

SEQ ID NO: 4534 - RNA, 27 nt, Artificial Sequence
  Synthetic oligonucleotide
aaaaaauguuggacuaggcauguucag

SEQ ID NO: 4535 - RNA, 27 nt, Artificial Sequence
  Synthetic oligonucleotide
gaaaaaauguuggacuaggcauguuca

SEQ ID NO: 4536 - RNA, 27 nt, Artificial Sequence
  Synthetic oligonucleotide
ggaaaaaauguuggacuaggcauguuc

SEQ ID NO: 4537 - RNA, 27 nt, Artificial Sequence
  Synthetic oligonucleotide
gggaaaaaauguuggacuaggcauguu

SEQ ID NO: 4538 - RNA, 27 nt, Artificial Sequence
  Synthetic oligonucleotide
ugggaaaaaauguuggacuaggcaugu

SEQ ID NO: 4539 - RNA, 27 nt, Artificial Sequence
  Synthetic oligonucleotide
cugggaaaaaauguuggacuaggcaug

SEQ ID NO: 4540 - RNA, 27 nt, Artificial Sequence
  Synthetic oligonucleotide
acugggaaaaaauguuggacuaggcau

SEQ ID NO: 4541 - RNA, 27 nt, Artificial Sequence
  Synthetic oligonucleotide
cacugggaaaaaauguuggacuaggca

SEQ ID NO: 4542 - RNA, 27 nt, Artificial Sequence
  Synthetic oligonucleotide
ucacugggaaaaaauguuggacuaggc

SEQ ID NO: 4543 - RNA, 27 nt, Artificial Sequence
  Synthetic oligonucleotide
cucacugggaaaaaauguuggacuagg

SEQ ID NO: 4544 - RNA, 27 nt, Artificial Sequence
  Synthetic oligonucleotide
acucacugggaaaaaauguuggacuag

SEQ ID NO: 4545 - RNA, 27 nt, Artificial Sequence
  Synthetic oligonucleotide
gacucacugggaaaaaauguuggacua

SEQ ID NO: 4546 - RNA, 27 nt, Artificial Sequence
  Synthetic oligonucleotide
ugacucacugggaaaaaauguuggacu

SEQ ID NO: 4547 - RNA, 27 nt, Artificial Sequence
  Synthetic oligonucleotide
gugacucacugggaaaaaauguuggac

SEQ ID NO: 4548 - RNA, 27 nt, Artificial Sequence
  Synthetic oligonucleotide
ugugacucacugggaaaaaauguugga

SEQ ID NO: 4549 - RNA, 27 nt, Artificial Sequence
  Synthetic oligonucleotide
augugacucacugggaaaaaauguugg

SEQ ID NO: 4550 - RNA, 27 nt, Artificial Sequence
  Synthetic oligonucleotide
gaugugacucacugggaaaaaauguug

SEQ ID NO: 4551 - RNA, 27 nt, Artificial Sequence
  Synthetic oligonucleotide
ggaugugacucacugggaaaaaauguu

SEQ ID NO: 4552 - RNA, 27 nt, Artificial Sequence
  Synthetic oligonucleotide
aggaugugacucacugggaaaaaaugu

SEQ ID NO: 4553 - RNA, 27 nt, Artificial Sequence
  Synthetic oligonucleotide
caggaugugacucacugggaaaaaaug

SEQ ID NO: 4554 - RNA, 27 nt, Artificial Sequence
  Synthetic oligonucleotide
ccaggaugugacucacugggaaaaaau

SEQ ID NO: 4555 - RNA, 27 nt, Artificial Sequence
  Synthetic oligonucleotide
cccaggaugugacucacugggaaaaaa

SEQ ID NO: 4556 - RNA, 27 nt, Artificial Sequence
  Synthetic oligonucleotide
ucccaggaugugacucacugggaaaaa

SEQ ID NO: 4557 - RNA, 27 nt, Artificial Sequence
  Synthetic oligonucleotide
aucccaggaugugacucacugggaaaa

SEQ ID NO: 4558 - RNA, 27 nt, Artificial Sequence
  Synthetic oligonucleotide
gaucccaggaugugacucacugggaaa

SEQ ID NO: 4559 - RNA, 27 nt, Artificial Sequence
  Synthetic oligonucleotide
ggaucccaggaugugacucacugggaa

SEQ ID NO: 4560 - RNA, 27 nt, Artificial Sequence
  Synthetic oligonucleotide
uggaucccaggaugugacucacuggga

SEQ ID NO: 4561 - RNA, 27 nt, Artificial Sequence
  Synthetic oligonucleotide
cuggaucccaggaugugacucacuggg

SEQ ID NO: 4562 - RNA, 27 nt, Artificial Sequence
  Synthetic oligonucleotide
acuggaucccaggaugugacucacugg

SEQ ID NO: 4563 - RNA, 27 nt, Artificial Sequence
  Synthetic oligonucleotide
cacuggaucccaggaugugacucacug

SEQ ID NO: 4564 - RNA, 27 nt, Artificial Sequence
  Synthetic oligonucleotide
acacuggaucccaggaugugacucacu

SEQ ID NO: 4565 - RNA, 27 nt, Artificial Sequence
  Synthetic oligonucleotide
uacacuggaucccaggaugugacucac

SEQ ID NO: 4566 - RNA, 27 nt, Artificial Sequence
  Synthetic oligonucleotide
auacacuggaucccaggaugugacuca

SEQ ID NO: 4567 - RNA, 27 nt, Artificial Sequence
  Synthetic oligonucleotide
uauacacuggaucccaggaugugacuc

SEQ ID NO: 4568 - RNA, 27 nt, Artificial Sequence
  Synthetic oligonucleotide
uuauacacuggaucccaggaugugacu

SEQ ID NO: 4569 - RNA, 27 nt, Artificial Sequence
  Synthetic oligonucleotide
uuuauacacuggaucccaggaugugac

SEQ ID NO: 4570 - RNA, 27 nt, Artificial Sequence
  Synthetic oligonucleotide
auuuauacacuggaucccaggauguga

SEQ ID NO: 4571 - RNA, 27 nt, Artificial Sequence
  Synthetic oligonucleotide
gauuuauacacuggaucccaggaugug

SEQ ID NO: 4572 - RNA, 27 nt, Artificial Sequence
  Synthetic oligonucleotide
ggauuuauacacuggaucccaggaugu

SEQ ID NO: 4573 - RNA, 27 nt, Artificial Sequence
  Synthetic oligonucleotide
uggauuuauacacuggaucccaggaug

SEQ ID NO: 4574 - RNA, 27 nt, Artificial Sequence
  Synthetic oligonucleotide
uuggauuuauacacuggaucccaggau

SEQ ID NO: 4575 - RNA, 27 nt, Artificial Sequence
  Synthetic oligonucleotide
auuggauuuauacacuggaucccagga

SEQ ID NO: 4576 - RNA, 27 nt, Artificial Sequence
  Synthetic oligonucleotide
uauuggauuuauacacuggaucccagg

SEQ ID NO: 4577 - RNA, 27 nt, Artificial Sequence
  Synthetic oligonucleotide
auauuggauuuauacacuggaucccag

SEQ ID NO: 4578 - RNA, 27 nt, Artificial Sequence
  Synthetic oligonucleotide
gauauuggauuuauacacuggauccca

SEQ ID NO: 4579 - RNA, 27 nt, Artificial Sequence
  Synthetic oligonucleotide
ugauauuggauuuauacacuggauccc

SEQ ID NO: 4580 - RNA, 27 nt, Artificial Sequence
  Synthetic oligonucleotide
caugauauuggauuuauacacuggauc

SEQ ID NO: 4581 - RNA, 27 nt, Artificial Sequence
  Synthetic oligonucleotide
acaugauauuggauuuauacacuggau

SEQ ID NO: 4582 - RNA, 27 nt, Artificial Sequence
  Synthetic oligonucleotide
gacaugauauuggauuuauacacugga

SEQ ID NO: 4583 - RNA, 27 nt, Artificial Sequence
  Synthetic oligonucleotide
aagacaugauauuggauuuauacacug

SEQ ID NO: 4584 - RNA, 27 nt, Artificial Sequence
  Synthetic oligonucleotide
caagacaugauauuggauuuauacacu

SEQ ID NO: 4585 - RNA, 27 nt, Artificial Sequence
  Synthetic oligonucleotide
acaagacaugauauuggauuuauacac

SEQ ID NO: 4586 - RNA, 27 nt, Artificial Sequence
  Synthetic oligonucleotide
cacaagacaugauauuggauuuauaca

SEQ ID NO: 4587 - RNA, 27 nt, Artificial Sequence
  Synthetic oligonucleotide
gcacaagacaugauauuggauuuauac

SEQ ID NO: 4588 - RNA, 27 nt, Artificial Sequence
  Synthetic oligonucleotide
ugcacaagacaugauauuggauuuaua

SEQ ID NO: 4589 - RNA, 27 nt, Artificial Sequence
  Synthetic oligonucleotide
augcacaagacaugauauuggauuuau

SEQ ID NO: 4590 - RNA, 27 nt, Artificial Sequence
  Synthetic oligonucleotide
uaugcacaagacaugauauuggauuua

SEQ ID NO: 4591 - RNA, 27 nt, Artificial Sequence
  Synthetic oligonucleotide
uuaugcacaagacaugauauuggauuu

SEQ ID NO: 4592 - RNA, 27 nt, Artificial Sequence
  Synthetic oligonucleotide
auuaugcacaagacaugauauuggauu

SEQ ID NO: 4593 - RNA, 27 nt, Artificial Sequence
  Synthetic oligonucleotide
aauuaugcacaagacaugauauuggau

SEQ ID NO: 4594 - RNA, 27 nt, Artificial Sequence
  Synthetic oligonucleotide
gaauuaugcacaagacaugauauugga

SEQ ID NO: 4595 - RNA, 27 nt, Artificial Sequence
  Synthetic oligonucleotide
agaauuaugcacaagacaugauauugg

SEQ ID NO: 4596 - RNA, 27 nt, Artificial Sequence
  Synthetic oligonucleotide
aagaauuaugcacaagacaugauauug

SEQ ID NO: 4597 - RNA, 27 nt, Artificial Sequence
  Synthetic oligonucleotide
gaagaauuaugcacaagacaugauauu

SEQ ID NO: 4598 - RNA, 27 nt, Artificial Sequence
  Synthetic oligonucleotide
ggaagaauuaugcacaagacaugauau

SEQ ID NO: 4599 - RNA, 27 nt, Artificial Sequence
  Synthetic oligonucleotide
uggaagaauuaugcacaagacaugaua

SEQ ID NO: 4600 - RNA, 27 nt, Artificial Sequence
  Synthetic oligonucleotide
uuggaagaauuaugcacaagacaugau

SEQ ID NO: 4601 - RNA, 27 nt, Artificial Sequence
  Synthetic oligonucleotide
uuuggaagaauuaugcacaagacauga

SEQ ID NO: 4602 - RNA, 27 nt, Artificial Sequence
  Synthetic oligonucleotide
cuuuggaagaauuaugcacaagacaug

SEQ ID NO: 4603 - RNA, 27 nt, Artificial Sequence
  Synthetic oligonucleotide
ccuuuggaagaauuaugcacaagacau

SEQ ID NO: 4604 - RNA, 27 nt, Artificial Sequence
  Synthetic oligonucleotide
uccuuuggaagaauuaugcacaagaca

SEQ ID NO: 4605 - RNA, 27 nt, Artificial Sequence
  Synthetic oligonucleotide
auccuuuggaagaauuaugcacaagac

SEQ ID NO: 4606 - RNA, 27 nt, Artificial Sequence
  Synthetic oligonucleotide
gauccuuuggaagaauuaugcacaaga

SEQ ID NO: 4607 - RNA, 27 nt, Artificial Sequence
  Synthetic oligonucleotide
agauccuuuggaagaauuaugcacaag

SEQ ID NO: 4608 - RNA, 27 nt, Artificial Sequence
  Synthetic oligonucleotide
aagauccuuuggaagaauuaugcacaa

SEQ ID NO: 4609 - RNA, 27 nt, Artificial Sequence
  Synthetic oligonucleotide
uaagauccuuuggaagaauuaugcaca

SEQ ID NO: 4610 - RNA, 27 nt, Artificial Sequence
  Synthetic oligonucleotide
auaagauccuuuggaagaauuaugcac

SEQ ID NO: 4611 - RNA, 27 nt, Artificial Sequence
  Synthetic oligonucleotide
aauaagauccuuuggaagaauuaugca

SEQ ID NO: 4612 - RNA, 27 nt, Artificial Sequence
  Synthetic oligonucleotide
aaauaagauccuuuggaagaauuaugc

SEQ ID NO: 4613 - RNA, 27 nt, Artificial Sequence
  Synthetic oligonucleotide
aaaauaagauccuuuggaagaauuaug

SEQ ID NO: 4614 - RNA, 27 nt, Artificial Sequence
  Synthetic oligonucleotide
caaaauaagauccuuuggaagaauuau

SEQ ID NO: 4615 - RNA, 27 nt, Artificial Sequence
  Synthetic oligonucleotide
acaaaauaagauccuuuggaagaauua

SEQ ID NO: 4616 - RNA, 27 nt, Artificial Sequence
  Synthetic oligonucleotide
cacaaaauaagauccuuuggaagaauu

SEQ ID NO: 4617 - RNA, 27 nt, Artificial Sequence
  Synthetic oligonucleotide
ucacaaaauaagauccuuuggaagaau

SEQ ID NO: 4618 - RNA, 27 nt, Artificial Sequence
  Synthetic oligonucleotide
uucacaaaauaagauccuuuggaagaa

SEQ ID NO: 4619 - RNA, 27 nt, Artificial Sequence
  Synthetic oligonucleotide
guucacaaaauaagauccuuuggaaga

SEQ ID NO: 4620 - RNA, 27 nt, Artificial Sequence
  Synthetic oligonucleotide
aguucacaaaauaagauccuuuggaag

SEQ ID NO: 4621 - RNA, 27 nt, Artificial Sequence
  Synthetic oligonucleotide
uaguucacaaaauaagauccuuuggaa

SEQ ID NO: 4622 - RNA, 27 nt, Artificial Sequence
  Synthetic oligonucleotide
auaguucacaaaauaagauccuuugga

SEQ ID NO: 4623 - RNA, 27 nt, Artificial Sequence
  Synthetic oligonucleotide
uauaguucacaaaauaagauccuuugg

SEQ ID NO: 4624 - RNA, 27 nt, Artificial Sequence
  Synthetic oligonucleotide
auauaguucacaaaauaagauccuuug

SEQ ID NO: 4625 - RNA, 27 nt, Artificial Sequence
  Synthetic oligonucleotide
gauauaguucacaaaauaagauccuuu

SEQ ID NO: 4626 - RNA, 27 nt, Artificial Sequence
  Synthetic oligonucleotide
ugauauaguucacaaaauaagauccuu

SEQ ID NO: 4627 - RNA, 27 nt, Artificial Sequence
  Synthetic oligonucleotide
cugauauaguucacaaaauaagauccu

SEQ ID NO: 4628 - RNA, 27 nt, Artificial Sequence
  Synthetic oligonucleotide
acugauauaguucacaaaauaagaucc

SEQ ID NO: 4629 - RNA, 27 nt, Artificial Sequence
  Synthetic oligonucleotide
uacugauauaguucacaaaauaagauc

SEQ ID NO: 4630 - RNA, 27 nt, Artificial Sequence
  Synthetic oligonucleotide
acuacugauauaguucacaaaauaaga

SEQ ID NO: 4631 - RNA, 27 nt, Artificial Sequence
  Synthetic oligonucleotide
cacuacugauauaguucacaaaauaag

SEQ ID NO: 4632 - RNA, 27 nt, Artificial Sequence
  Synthetic oligonucleotide
acacuacugauauaguucacaaaauaa

SEQ ID NO: 4633 - RNA, 27 nt, Artificial Sequence
  Synthetic oligonucleotide
uacacuacugauauaguucacaaaaua

SEQ ID NO: 4634 - RNA, 27 nt, Artificial Sequence
  Synthetic oligonucleotide
guacacuacugauauaguucacaaaau

SEQ ID NO: 4635 - RNA, 27 nt, Artificial Sequence
  Synthetic oligonucleotide
uguacacuacugauauaguucacaaaa

SEQ ID NO: 4636 - RNA, 27 nt, Artificial Sequence
  Synthetic oligonucleotide
auguacacuacugauauaguucacaaa

SEQ ID NO: 4637 - RNA, 27 nt, Artificial Sequence
  Synthetic oligonucleotide
aauguacacuacugauauaguucacaa

SEQ ID NO: 4638 - RNA, 27 nt, Artificial Sequence
  Synthetic oligonucleotide
uaauguacacuacugauauaguucaca

SEQ ID NO: 4639 - RNA, 27 nt, Artificial Sequence
  Synthetic oligonucleotide
guaauguacacuacugauauaguucac

SEQ ID NO: 4640 - RNA, 27 nt, Artificial Sequence
  Synthetic oligonucleotide
gguaauguacacuacugauauaguuca

SEQ ID NO: 4641 - RNA, 27 nt, Artificial Sequence
  Synthetic oligonucleotide
ugguaauguacacuacugauauaguuc

SEQ ID NO: 4642 - RNA, 27 nt, Artificial Sequence
  Synthetic oligonucleotide
augguaauguacacuacugauauaguu

SEQ ID NO: 4643 - RNA, 27 nt, Artificial Sequence
  Synthetic oligonucleotide
auaugguaauguacacuacugauauag

SEQ ID NO: 4644 - RNA, 27 nt, Artificial Sequence
  Synthetic oligonucleotide
uauaugguaauguacacuacugauaua

SEQ ID NO: 4645 - RNA, 27 nt, Artificial Sequence
  Synthetic oligonucleotide
cauuauaugguaauguacacuacugau

SEQ ID NO: 4646 - RNA, 27 nt, Artificial Sequence
  Synthetic oligonucleotide
acauuauaugguaauguacacuacuga

SEQ ID NO: 4647 - RNA, 27 nt, Artificial Sequence
  Synthetic oligonucleotide
uacauuauaugguaauguacacuacug

SEQ ID NO: 4648 - RNA, 27 nt, Artificial Sequence
  Synthetic oligonucleotide
uuacauuauaugguaauguacacuacu

SEQ ID NO: 4649 - RNA, 27 nt, Artificial Sequence
  Synthetic oligonucleotide
uuuacauuauaugguaauguacacuac

SEQ ID NO: 4650 - RNA, 27 nt, Artificial Sequence
  Synthetic oligonucleotide
uuuuacauuauaugguaauguacacua

SEQ ID NO: 4651 - RNA, 27 nt, Artificial Sequence
  Synthetic oligonucleotide
uuuuuacauuauaugguaauguacacu

SEQ ID NO: 4652 - RNA, 27 nt, Artificial Sequence
  Synthetic oligonucleotide
cuuuuuacauuauaugguaauguacac

SEQ ID NO: 4653 - RNA, 27 nt, Artificial Sequence
  Synthetic oligonucleotide
ucuuuuuacauuauaugguaauguaca

SEQ ID NO: 4654 - RNA, 27 nt, Artificial Sequence
  Synthetic oligonucleotide
aucuuuuuacauuauaugguaauguac

SEQ ID NO: 4655 - RNA, 27 nt, Artificial Sequence
  Synthetic oligonucleotide
gaucuuuuuacauuauaugguaaugua

SEQ ID NO: 4656 - RNA, 27 nt, Artificial Sequence
  Synthetic oligonucleotide
agaucuuuuuacauuauaugguaaugu

SEQ ID NO: 4657 - RNA, 27 nt, Artificial Sequence
  Synthetic oligonucleotide
uagaucuuuuuacauuauaugguaaug

SEQ ID NO: 4658 - RNA, 27 nt, Artificial Sequence
  Synthetic oligonucleotide
guagaucuuuuuacauuauaugguaau

SEQ ID NO: 4659 - RNA, 27 nt, Artificial Sequence
  Synthetic oligonucleotide
uguagaucuuuuuacauuauaugguaa

SEQ ID NO: 4660 - RNA, 27 nt, Artificial Sequence
  Synthetic oligonucleotide
auguagaucuuuuuacauuauauggua

SEQ ID NO: 4661 - RNA, 27 nt, Artificial Sequence
  Synthetic oligonucleotide
uauguagaucuuuuuacauuauauggu

SEQ ID NO: 4662 - RNA, 27 nt, Artificial Sequence
  Synthetic oligonucleotide
guauguagaucuuuuuacauuauaugg

SEQ ID NO: 4663 - RNA, 27 nt, Artificial Sequence
  Synthetic oligonucleotide
uguauguagaucuuuuuacauuauaug

SEQ ID NO: 4664 - RNA, 27 nt, Artificial Sequence
  Synthetic oligonucleotide
uuguauguagaucuuuuuacauuauau

SEQ ID NO: 4665 - RNA, 27 nt, Artificial Sequence
  Synthetic oligonucleotide
uuuguauguagaucuuuuuacauuaua

SEQ ID NO: 4666 - RNA, 27 nt, Artificial Sequence
  Synthetic oligonucleotide
guuuguauguagaucuuuuuacauuau

SEQ ID NO: 4667 - RNA, 27 nt, Artificial Sequence
  Synthetic oligonucleotide
uguuuguauguagaucuuuuuacauua

SEQ ID NO: 4668 - RNA, 27 nt, Artificial Sequence
  Synthetic oligonucleotide
uuguuuguauguagaucuuuuuacauu

SEQ ID NO: 4669 - RNA, 27 nt, Artificial Sequence
  Synthetic oligonucleotide
auuguuuguauguagaucuuuuuacau

SEQ ID NO: 4670 - RNA, 27 nt, Artificial Sequence
  Synthetic oligonucleotide
cauuguuuguauguagaucuuuuuaca

SEQ ID NO: 4671 - RNA, 27 nt, Artificial Sequence
  Synthetic oligonucleotide
gcauuguuuguauguagaucuuuuuac

SEQ ID NO: 4672 - RNA, 27 nt, Artificial Sequence
  Synthetic oligonucleotide
ugcauuguuuguauguagaucuuuuua

SEQ ID NO: 4673 - RNA, 27 nt, Artificial Sequence
  Synthetic oligonucleotide
uugcauuguuuguauguagaucuuuuu

SEQ ID NO: 4674 - RNA, 27 nt, Artificial Sequence
  Synthetic oligonucleotide
guugcauuguuuguauguagaucuuuu

SEQ ID NO: 4675 - RNA, 27 nt, Artificial Sequence
  Synthetic oligonucleotide
gguugcauuguuuguauguagaucuuu

SEQ ID NO: 4676 - RNA, 27 nt, Artificial Sequence
  Synthetic oligonucleotide
ugguugcauuguuuguauguagaucuu

SEQ ID NO: 4677 - RNA, 27 nt, Artificial Sequence
  Synthetic oligonucleotide
uugguugcauuguuuguauguagaucu

SEQ ID NO: 4678 - RNA, 27 nt, Artificial Sequence
  Synthetic oligonucleotide
guugguugcauuguuuguauguagauc

SEQ ID NO: 4679 - RNA, 27 nt, Artificial Sequence
  Synthetic oligonucleotide
aguugguugcauuguuuguauguagau

SEQ ID NO: 4680 - RNA, 27 nt, Artificial Sequence
  Synthetic oligonucleotide
uaguugguugcauuguuuguauguaga

SEQ ID NO: 4681 - RNA, 27 nt, Artificial Sequence
  Synthetic oligonucleotide
auaguugguugcauuguuuguauguag

SEQ ID NO: 4682 - RNA, 27 nt, Artificial Sequence
  Synthetic oligonucleotide
gauaguugguugcauuguuuguaugua

SEQ ID NO: 4683 - RNA, 27 nt, Artificial Sequence
  Synthetic oligonucleotide
ggauaguugguugcauuguuuguaugu

SEQ ID NO: 4684 - RNA, 27 nt, Artificial Sequence
  Synthetic oligonucleotide
uggauaguugguugcauuguuuguaug

SEQ ID NO: 4685 - RNA, 27 nt, Artificial Sequence
  Synthetic oligonucleotide
uuggauaguugguugcauuguuuguau

SEQ ID NO: 4686 - RNA, 27 nt, Artificial Sequence
  Synthetic oligonucleotide
cuuggauaguugguugcauuguuugua

SEQ ID NO: 4687 - RNA, 27 nt, Artificial Sequence
  Synthetic oligonucleotide
acuuggauaguugguugcauuguuugu

SEQ ID NO: 4688 - RNA, 27 nt, Artificial Sequence
  Synthetic oligonucleotide
cacuuggauaguugguugcauuguuug

SEQ ID NO: 4689 - RNA, 27 nt, Artificial Sequence
  Synthetic oligonucleotide
acacuuggauaguugguugcauuguuu

SEQ ID NO: 4690 - RNA, 27 nt, Artificial Sequence
  Synthetic oligonucleotide
aacacuuggauaguugguugcauuguu

SEQ ID NO: 4691 - RNA, 27 nt, Artificial Sequence
  Synthetic oligonucleotide
uaacacuuggauaguugguugcauugu

SEQ ID NO: 4692 - RNA, 27 nt, Artificial Sequence
  Synthetic oligonucleotide
auaacacuuggauaguugguugcauug

SEQ ID NO: 4693 - RNA, 27 nt, Artificial Sequence
  Synthetic oligonucleotide
uauaacacuuggauaguugguugcauu

SEQ ID NO: 4694 - RNA, 27 nt, Artificial Sequence
  Synthetic oligonucleotide
guauaacacuuggauaguugguugcau

SEQ ID NO: 4695 - RNA, 27 nt, Artificial Sequence
  Synthetic oligonucleotide
aguugguauaacacuuggauaguuggu

SEQ ID NO: 4696 - RNA, 27 nt, Artificial Sequence
  Synthetic oligonucleotide
uaguugguauaacacuuggauaguugg

SEQ ID NO: 4697 - RNA, 27 nt, Artificial Sequence
  Synthetic oligonucleotide
uuuuaguugguauaacacuuggauagu

SEQ ID NO: 4698 - RNA, 27 nt, Artificial Sequence
  Synthetic oligonucleotide
guuuuaguugguauaacacuuggauag

SEQ ID NO: 4699 - RNA, 27 nt, Artificial Sequence
  Synthetic oligonucleotide
gggguuuuaguugguauaacacuugga

SEQ ID NO: 4700 - RNA, 27 nt, Artificial Sequence
  Synthetic oligonucleotide
ggggguuuuaguugguauaacacuugg

SEQ ID NO: 4701 - RNA, 27 nt, Artificial Sequence
  Synthetic oligonucleotide
uggggguuuuaguugguauaacacuug

SEQ ID NO: 4702 - RNA, 27 nt, Artificial Sequence
  Synthetic oligonucleotide
uuggggguuuuaguugguauaacacuu

SEQ ID NO: 4703 - RNA, 27 nt, Artificial Sequence
  Synthetic oligonucleotide
auuggggguuuuaguugguauaacacu

SEQ ID NO: 4704 - RNA, 27 nt, Artificial Sequence
  Synthetic oligonucleotide
uauuggggguuuuaguugguauaacac

SEQ ID NO: 4705 - RNA, 27 nt, Artificial Sequence
  Synthetic oligonucleotide
uuauuggggguuuuaguugguauaaca

SEQ ID NO: 4706 - RNA, 27 nt, Artificial Sequence
  Synthetic oligonucleotide
uuuauuggggguuuuaguugguauaac

SEQ ID NO: 4707 - RNA, 27 nt, Artificial Sequence
  Synthetic oligonucleotide
guuuauuggggguuuuaguugguauaa

SEQ ID NO: 4708 - RNA, 27 nt, Artificial Sequence
  Synthetic oligonucleotide
gguuuauuggggguuuuaguugguaua

SEQ ID NO: 4709 - RNA, 27 nt, Artificial Sequence
  Synthetic oligonucleotide
agguuuauuggggguuuuaguugguau

SEQ ID NO: 4710 - RNA, 27 nt, Artificial Sequence
  Synthetic oligonucleotide
aagguuuauuggggguuuuaguuggua

SEQ ID NO: 4711 - RNA, 27 nt, Artificial Sequence
  Synthetic oligonucleotide
caagguuuauuggggguuuuaguuggu

SEQ ID NO: 4712 - RNA, 27 nt, Artificial Sequence
  Synthetic oligonucleotide
ucaagguuuauuggggguuuuaguugg

SEQ ID NO: 4713 - RNA, 27 nt, Artificial Sequence
  Synthetic oligonucleotide
uucaagguuuauuggggguuuuaguug

SEQ ID NO: 4714 - RNA, 27 nt, Artificial Sequence
  Synthetic oligonucleotide
guucaagguuuauuggggguuuuaguu

SEQ ID NO: 4715 - RNA, 27 nt, Artificial Sequence
  Synthetic oligonucleotide
uguucaagguuuauuggggguuuuagu

SEQ ID NO: 4716 - RNA, 27 nt, Artificial Sequence
  Synthetic oligonucleotide
cuguucaagguuuauuggggguuuuag

SEQ ID NO: 4717 - RNA, 27 nt, Artificial Sequence
  Synthetic oligonucleotide
acuguucaagguuuauuggggguuuua

SEQ ID NO: 4718 - RNA, 27 nt, Artificial Sequence
  Synthetic oligonucleotide
cacuguucaagguuuauuggggguuuu

SEQ ID NO: 4719 - RNA, 27 nt, Artificial Sequence
  Synthetic oligonucleotide
ucacuguucaagguuuauuggggguuu

SEQ ID NO: 4720 - RNA, 27 nt, Artificial Sequence
  Synthetic oligonucleotide
gucacuguucaagguuuauuggggguu

SEQ ID NO: 4721 - RNA, 27 nt, Artificial Sequence
  Synthetic oligonucleotide
agucacuguucaagguuuauugggggu

SEQ ID NO: 4722 - RNA, 27 nt, Artificial Sequence
  Synthetic oligonucleotide
uagucacuguucaagguuuauuggggg

SEQ ID NO: 4723 - RNA, 27 nt, Artificial Sequence
  Synthetic oligonucleotide
guagucacuguucaagguuuauugggg

SEQ ID NO: 4724 - RNA, 27 nt, Artificial Sequence
  Synthetic oligonucleotide
aguagucacuguucaagguuuauuggg

SEQ ID NO: 4725 - RNA, 27 nt, Artificial Sequence
  Synthetic oligonucleotide
aaguagucacuguucaagguuuauugg

SEQ ID NO: 4726 - RNA, 27 nt, Artificial Sequence
  Synthetic oligonucleotide
aaaguagucacuguucaagguuuauug

SEQ ID NO: 4727 - RNA, 27 nt, Artificial Sequence
  Synthetic oligonucleotide
caaaguagucacuguucaagguuuauu

SEQ ID NO: 4728 - RNA, 27 nt, Artificial Sequence
  Synthetic oligonucleotide
ccaaaguagucacuguucaagguuuau

SEQ ID NO: 4729 - RNA, 27 nt, Artificial Sequence
  Synthetic oligonucleotide
accaaaguagucacuguucaagguuua

SEQ ID NO: 4730 - RNA, 27 nt, Artificial Sequence
  Synthetic oligonucleotide
aaccaaaguagucacuguucaagguuu

SEQ ID NO: 4731 - RNA, 27 nt, Artificial Sequence
  Synthetic oligonucleotide
uaaccaaaguagucacuguucaagguu

SEQ ID NO: 4732 - RNA, 27 nt, Artificial Sequence
  Synthetic oligonucleotide
uuaaccaaaguagucacuguucaaggu

SEQ ID NO: 4733 - RNA, 27 nt, Artificial Sequence
  Synthetic oligonucleotide
auuaaccaaaguagucacuguucaagg

SEQ ID NO: 4734 - RNA, 27 nt, Artificial Sequence
  Synthetic oligonucleotide
aauuaaccaaaguagucacuguucaag

SEQ ID NO: 4735 - RNA, 27 nt, Artificial Sequence
  Synthetic oligonucleotide
gaauuaaccaaaguagucacuguucaa

SEQ ID NO: 4736 - RNA, 27 nt, Artificial Sequence
  Synthetic oligonucleotide
ugaauuaaccaaaguagucacuguuca

SEQ ID NO: 4737 - RNA, 27 nt, Artificial Sequence
  Synthetic oligonucleotide
augaauuaaccaaaguagucacuguuc

SEQ ID NO: 4738 - RNA, 27 nt, Artificial Sequence
  Synthetic oligonucleotide
aaugaauuaaccaaaguagucacuguu

SEQ ID NO: 4739 - RNA, 27 nt, Artificial Sequence
  Synthetic oligonucleotide
uaaugaauuaaccaaaguagucacugu

SEQ ID NO: 4740 - RNA, 27 nt, Artificial Sequence
  Synthetic oligonucleotide
auaaugaauuaaccaaaguagucacug

SEQ ID NO: 4741 - RNA, 27 nt, Artificial Sequence
  Synthetic oligonucleotide
uauaaugaauuaaccaaaguagucacu

SEQ ID NO: 4742 - RNA, 27 nt, Artificial Sequence
  Synthetic oligonucleotide
auauaaugaauuaaccaaaguagucac

SEQ ID NO: 4743 - RNA, 27 nt, Artificial Sequence
  Synthetic oligonucleotide
aauauaaugaauuaaccaaaguaguca

SEQ ID NO: 4744 - RNA, 27 nt, Artificial Sequence
  Synthetic oligonucleotide
uaauauaaugaauuaaccaaaguaguc

SEQ ID NO: 4745 - RNA, 27 nt, Artificial Sequence
  Synthetic oligonucleotide
uuaauauaaugaauuaaccaaaguagu

SEQ ID NO: 4746 - RNA, 27 nt, Artificial Sequence
  Synthetic oligonucleotide
cuuaauauaaugaauuaaccaaaguag

SEQ ID NO: 4747 - RNA, 27 nt, Artificial Sequence
  Synthetic oligonucleotide
ucuuaauauaaugaauuaaccaaagua

SEQ ID NO: 4748 - RNA, 27 nt, Artificial Sequence
  Synthetic oligonucleotide
aucuuaauauaaugaauuaaccaaagu

SEQ ID NO: 4749 - RNA, 27 nt, Artificial Sequence
  Synthetic oligonucleotide
uaucuuaauauaaugaauuaaccaaag

SEQ ID NO: 4750 - RNA, 27 nt, Artificial Sequence
  Synthetic oligonucleotide
auaucuuaauauaaugaauuaaccaaa

SEQ ID NO: 4751 - RNA, 27 nt, Artificial Sequence
  Synthetic oligonucleotide
uauaucuuaauauaaugaauuaaccaa

SEQ ID NO: 4752 - RNA, 27 nt, Artificial Sequence
  Synthetic oligonucleotide
uuauaucuuaauauaaugaauuaacca

SEQ ID NO: 4753 - RNA, 27 nt, Artificial Sequence
  Synthetic oligonucleotide
uuuauaucuuaauauaaugaauuaacc

SEQ ID NO: 4754 - RNA, 27 nt, Artificial Sequence
  Synthetic oligonucleotide
cuuuauaucuuaauauaaugaauuaac

SEQ ID NO: 4755 - RNA, 27 nt, Artificial Sequence
  Synthetic oligonucleotide
acuuuauaucuuaauauaaugaauuaa

SEQ ID NO: 4756 - RNA, 27 nt, Artificial Sequence
  Synthetic oligonucleotide
gacuuuauaucuuaauauaaugaauua

SEQ ID NO: 4757 - RNA, 27 nt, Artificial Sequence
  Synthetic oligonucleotide
ugacuuuauaucuuaauauaaugaauu

SEQ ID NO: 4758 - RNA, 27 nt, Artificial Sequence
  Synthetic oligonucleotide
augacuuuauaucuuaauauaaugaau

SEQ ID NO: 4759 - RNA, 27 nt, Artificial Sequence
  Synthetic oligonucleotide
uaugacuuuauaucuuaauauaaugaa

SEQ ID NO: 4760 - RNA, 27 nt, Artificial Sequence
  Synthetic oligonucleotide
uuaugacuuuauaucuuaauauaauga

SEQ ID NO: 4761 - RNA, 27 nt, Artificial Sequence
  Synthetic oligonucleotide
uuuaugacuuuauaucuuaauauaaug

SEQ ID NO: 4762 - RNA, 27 nt, Artificial Sequence
  Synthetic oligonucleotide
cuuuaugacuuuauaucuuaauauaau

SEQ ID NO: 4763 - RNA, 27 nt, Artificial Sequence
  Synthetic oligonucleotide
gcuuuaugacuuuauaucuuaauauaa

SEQ ID NO: 4764 - RNA, 27 nt, Artificial Sequence
  Synthetic oligonucleotide
agcuuuaugacuuuauaucuuaauaua

SEQ ID NO: 4765 - RNA, 27 nt, Artificial Sequence
  Synthetic oligonucleotide
cagcuuuaugacuuuauaucuuaauau

SEQ ID NO: 4766 - RNA, 27 nt, Artificial Sequence
  Synthetic oligonucleotide
gcagcuuuaugacuuuauaucuuaaua

SEQ ID NO: 4767 - RNA, 27 nt, Artificial Sequence
  Synthetic oligonucleotide
agcagcuuuaugacuuuauaucuuaau

SEQ ID NO: 4768 - RNA, 27 nt, Artificial Sequence
  Synthetic oligonucleotide
uagcagcuuuaugacuuuauaucuuaa

SEQ ID NO: 4769 - RNA, 27 nt, Artificial Sequence
  Synthetic oligonucleotide
cuagcagcuuuaugacuuuauaucuua

SEQ ID NO: 4770 - RNA, 27 nt, Artificial Sequence
  Synthetic oligonucleotide
acuagcagcuuuaugacuuuauaucuu

SEQ ID NO: 4771 - RNA, 27 nt, Artificial Sequence
  Synthetic oligonucleotide
aacuagcagcuuuaugacuuuauaucu

SEQ ID NO: 4772 - RNA, 27 nt, Artificial Sequence
  Synthetic oligonucleotide
uaacuagcagcuuuaugacuuuauauc

SEQ ID NO: 4773 - RNA, 27 nt, Artificial Sequence
  Synthetic oligonucleotide
auaacuagcagcuuuaugacuuuauau

SEQ ID NO: 4774 - RNA, 27 nt, Artificial Sequence
  Synthetic oligonucleotide
aauaacuagcagcuuuaugacuuuaua

SEQ ID NO: 4775 - RNA, 27 nt, Artificial Sequence
  Synthetic oligonucleotide
uaauaacuagcagcuuuaugacuuuau

SEQ ID NO: 4776 - RNA, 27 nt, Artificial Sequence
  Synthetic oligonucleotide
auaauaacuagcagcuuuaugacuuua

SEQ ID NO: 4777 - RNA, 27 nt, Artificial Sequence
  Synthetic oligonucleotide
uauaauaacuagcagcuuuaugacuuu

SEQ ID NO: 4778 - RNA, 27 nt, Artificial Sequence
  Synthetic oligonucleotide
auauaauaacuagcagcuuuaugacuu

SEQ ID NO: 4779 - RNA, 27 nt, Artificial Sequence
  Synthetic oligonucleotide
aauauaauaacuagcagcuuuaugacu

SEQ ID NO: 4780 - RNA, 27 nt, Artificial Sequence
  Synthetic oligonucleotide
uaauauaauaacuagcagcuuuaugac

SEQ ID NO: 4781 - RNA, 27 nt, Artificial Sequence
  Synthetic oligonucleotide
uuaauauaauaacuagcagcuuuauga

SEQ ID NO: 4782 - RNA, 27 nt, Artificial Sequence
  Synthetic oligonucleotide
auuaauauaauaacuagcagcuuuaug

SEQ ID NO: 4783 - RNA, 27 nt, Artificial Sequence
  Synthetic oligonucleotide
aauuaauauaauaacuagcagcuuuau

SEQ ID NO: 4784 - RNA, 27 nt, Artificial Sequence
  Synthetic oligonucleotide
aaauuaauauaauaacuagcagcuuua

SEQ ID NO: 4785 - RNA, 27 nt, Artificial Sequence
  Synthetic oligonucleotide
caaauuaauauaauaacuagcagcuuu

SEQ ID NO: 4786 - RNA, 27 nt, Artificial Sequence
  Synthetic oligonucleotide
ccaaauuaauauaauaacuagcagcuu

SEQ ID NO: 4787 - RNA, 27 nt, Artificial Sequence
  Synthetic oligonucleotide
uccaaauuaauauaauaacuagcagcu

SEQ ID NO: 4788 - RNA, 27 nt, Artificial Sequence
  Synthetic oligonucleotide
uuccaaauuaauauaauaacuagcagc

SEQ ID NO: 4789 - RNA, 27 nt, Artificial Sequence
  Synthetic oligonucleotide
uuuccaaauuaauauaauaacuagcag

SEQ ID NO: 4790 - RNA, 27 nt, Artificial Sequence
  Synthetic oligonucleotide
auuuccaaauuaauauaauaacuagca

SEQ ID NO: 4791 - RNA, 27 nt, Artificial Sequence
  Synthetic oligonucleotide
uauuuccaaauuaauauaauaacuagc

SEQ ID NO: 4792 - RNA, 27 nt, Artificial Sequence
  Synthetic oligonucleotide
auauuuccaaauuaauauaauaacuag

SEQ ID NO: 4793 - RNA, 27 nt, Artificial Sequence
  Synthetic oligonucleotide
aauauuuccaaauuaauauaauaacua

SEQ ID NO: 4794 - RNA, 27 nt, Artificial Sequence
  Synthetic oligonucleotide
uaauauuuccaaauuaauauaauaacu

SEQ ID NO: 4795 - RNA, 27 nt, Artificial Sequence
  Synthetic oligonucleotide
cuaauauuuccaaauuaauauaauaac

SEQ ID NO: 4796 - RNA, 27 nt, Artificial Sequence
  Synthetic oligonucleotide
ccuaauauuuccaaauuaauauaauaa

SEQ ID NO: 4797 - RNA, 27 nt, Artificial Sequence
  Synthetic oligonucleotide
gccuaauauuuccaaauuaauauaaua

SEQ ID NO: 4798 - RNA, 27 nt, Artificial Sequence
  Synthetic oligonucleotide
agccuaauauuuccaaauuaauauaau

SEQ ID NO: 4799 - RNA, 27 nt, Artificial Sequence
  Synthetic oligonucleotide
uagccuaauauuuccaaauuaauauaa

SEQ ID NO: 4800 - RNA, 27 nt, Artificial Sequence
  Synthetic oligonucleotide
auagccuaauauuuccaaauuaauaua

SEQ ID NO: 4801 - RNA, 27 nt, Artificial Sequence
  Synthetic oligonucleotide
aauagccuaauauuuccaaauuaauau

SEQ ID NO: 4802 - RNA, 27 nt, Artificial Sequence
  Synthetic oligonucleotide
gaauagccuaauauuuccaaauuaaua

SEQ ID NO: 4803 - RNA, 27 nt, Artificial Sequence
  Synthetic oligonucleotide
agaauagccuaauauuuccaaauuaau

SEQ ID NO: 4804 - RNA, 27 nt, Artificial Sequence
  Synthetic oligonucleotide
aagaauagccuaauauuuccaaauuaa

SEQ ID NO: 4805 - RNA, 27 nt, Artificial Sequence
  Synthetic oligonucleotide
caagaauagccuaauauuuccaaauua

SEQ ID NO: 4806 - RNA, 27 nt, Artificial Sequence
  Synthetic oligonucleotide
ccaagaauagccuaauauuuccaaauu

SEQ ID NO: 4807 - RNA, 27 nt, Artificial Sequence
  Synthetic oligonucleotide
cccaagaauagccuaauauuuccaaau

SEQ ID NO: 4808 - RNA, 27 nt, Artificial Sequence
  Synthetic oligonucleotide
gcccaagaauagccuaauauuuccaaa

SEQ ID NO: 4809 - RNA, 27 nt, Artificial Sequence
  Synthetic oligonucleotide
ugcccaagaauagccuaauauuuccaa

SEQ ID NO: 4810 - RNA, 27 nt, Artificial Sequence
  Synthetic oligonucleotide
uugcccaagaauagccuaauauuucca

SEQ ID NO: 4811 - RNA, 27 nt, Artificial Sequence
  Synthetic oligonucleotide
guugcccaagaauagccuaauauuucc

SEQ ID NO: 4812 - RNA, 27 nt, Artificial Sequence
  Synthetic oligonucleotide
gguugcccaagaauagccuaauauuuc

SEQ ID NO: 4813 - RNA, 27 nt, Artificial Sequence
  Synthetic oligonucleotide
ggguugcccaagaauagccuaauauuu

SEQ ID NO: 4814 - RNA, 27 nt, Artificial Sequence
  Synthetic oligonucleotide
aggguugcccaagaauagccuaauauu

SEQ ID NO: 4815 - RNA, 27 nt, Artificial Sequence
  Synthetic oligonucleotide
caggguugcccaagaauagccuaauau

SEQ ID NO: 4816 - RNA, 27 nt, Artificial Sequence
  Synthetic oligonucleotide
gcaggguugcccaagaauagccuaaua

SEQ ID NO: 4817 - RNA, 27 nt, Artificial Sequence
  Synthetic oligonucleotide
ugcaggguugcccaagaauagccuaau

SEQ ID NO: 4818 - RNA, 27 nt, Artificial Sequence
  Synthetic oligonucleotide
uugcaggguugcccaagaauagccuaa

SEQ ID NO: 4819 - RNA, 27 nt, Artificial Sequence
  Synthetic oligonucleotide
guugcaggguugcccaagaauagccua

SEQ ID NO: 4820 - RNA, 27 nt, Artificial Sequence
  Synthetic oligonucleotide
cguugcaggguugcccaagaauagccu

SEQ ID NO: 4821 - RNA, 27 nt, Artificial Sequence
  Synthetic oligonucleotide
ucguugcaggguugcccaagaauagcc

SEQ ID NO: 4822 - RNA, 27 nt, Artificial Sequence
  Synthetic oligonucleotide
aucguugcaggguugcccaagaauagc

SEQ ID NO: 4823 - RNA, 27 nt, Artificial Sequence
  Synthetic oligonucleotide
aaucguugcaggguugcccaagaauag

SEQ ID NO: 4824 - RNA, 27 nt, Artificial Sequence
  Synthetic oligonucleotide
aaaucguugcaggguugcccaagaaua

SEQ ID NO: 4825 - RNA, 27 nt, Artificial Sequence
  Synthetic oligonucleotide
aaaaucguugcaggguugcccaagaau

SEQ ID NO: 4826 - RNA, 27 nt, Artificial Sequence
  Synthetic oligonucleotide
aaaaaucguugcaggguugcccaagaa

SEQ ID NO: 4827 - RNA, 27 nt, Artificial Sequence
  Synthetic oligonucleotide
aaaaaaucguugcaggguugcccaaga

SEQ ID NO: 4828 - RNA, 27 nt, Artificial Sequence
  Synthetic oligonucleotide
gaaaaaaucguugcaggguugcccaag

SEQ ID NO: 4829 - RNA, 27 nt, Artificial Sequence
  Synthetic oligonucleotide
agaaaaaaucguugcaggguugcccaa

SEQ ID NO: 4830 - RNA, 27 nt, Artificial Sequence
  Synthetic oligonucleotide
uagaaaaaaucguugcaggguugccca

SEQ ID NO: 4831 - RNA, 27 nt, Artificial Sequence
  Synthetic oligonucleotide
uuagaaaaaaucguugcaggguugccc

SEQ ID NO: 4832 - RNA, 27 nt, Artificial Sequence
  Synthetic oligonucleotide
guuagaaaaaaucguugcaggguugcc

SEQ ID NO: 4833 - RNA, 27 nt, Artificial Sequence
  Synthetic oligonucleotide
uguuagaaaaaaucguugcaggguugc

SEQ ID NO: 4834 - RNA, 27 nt, Artificial Sequence
  Synthetic oligonucleotide
cuguuagaaaaaaucguugcaggguug

SEQ ID NO: 4835 - RNA, 27 nt, Artificial Sequence
  Synthetic oligonucleotide
ccuguuagaaaaaaucguugcaggguu

SEQ ID NO: 4836 - RNA, 27 nt, Artificial Sequence
  Synthetic oligonucleotide
cccuguuagaaaaaaucguugcagggu

SEQ ID NO: 4837 - RNA, 27 nt, Artificial Sequence
  Synthetic oligonucleotide
ucccuguuagaaaaaaucguugcaggg

SEQ ID NO: 4838 - RNA, 27 nt, Artificial Sequence
  Synthetic oligonucleotide
aucccuguuagaaaaaaucguugcagg

SEQ ID NO: 4839 - RNA, 27 nt, Artificial Sequence
  Synthetic oligonucleotide
uaucccuguuagaaaaaaucguugcag

SEQ ID NO: 4840 - RNA, 27 nt, Artificial Sequence
  Synthetic oligonucleotide
auaucccuguuagaaaaaaucguugca

SEQ ID NO: 4841 - RNA, 27 nt, Artificial Sequence
  Synthetic oligonucleotide
aauaucccuguuagaaaaaaucguugc

SEQ ID NO: 4842 - RNA, 27 nt, Artificial Sequence
  Synthetic oligonucleotide
uaauaucccuguuagaaaaaaucguug

SEQ ID NO: 4843 - RNA, 27 nt, Artificial Sequence
  Synthetic oligonucleotide
auaauaucccuguuagaaaaaaucguu

SEQ ID NO: 4844 - RNA, 27 nt, Artificial Sequence
  Synthetic oligonucleotide
aauaauaucccuguuagaaaaaaucgu

SEQ ID NO: 4845 - RNA, 27 nt, Artificial Sequence
  Synthetic oligonucleotide
caauaauaucccuguuagaaaaaaucg

SEQ ID NO: 4846 - RNA, 27 nt, Artificial Sequence
  Synthetic oligonucleotide
ucaauaauaucccuguuagaaaaaauc

SEQ ID NO: 4847 - RNA, 27 nt, Artificial Sequence
  Synthetic oligonucleotide
gucaauaauaucccuguuagaaaaaau

SEQ ID NO: 4848 - RNA, 27 nt, Artificial Sequence
  Synthetic oligonucleotide
agucaauaauaucccuguuagaaaaaa

SEQ ID NO: 4849 - RNA, 27 nt, Artificial Sequence
  Synthetic oligonucleotide
uagucaauaauaucccuguuagaaaaa

SEQ ID NO: 4850 - RNA, 27 nt, Artificial Sequence
  Synthetic oligonucleotide
uuagucaauaauaucccuguuagaaaa

SEQ ID NO: 4851 - RNA, 27 nt, Artificial Sequence
  Synthetic oligonucleotide
auuagucaauaauaucccuguuagaaa

SEQ ID NO: 4852 - RNA, 27 nt, Artificial Sequence
  Synthetic oligonucleotide
uauuagucaauaauaucccuguuagaa

SEQ ID NO: 4853 - RNA, 27 nt, Artificial Sequence
  Synthetic oligonucleotide
cuauuagucaauaauaucccuguuaga

SEQ ID NO: 4854 - RNA, 27 nt, Artificial Sequence
  Synthetic oligonucleotide
gcuauuagucaauaauaucccuguuag

SEQ ID NO: 4855 - RNA, 27 nt, Artificial Sequence
  Synthetic oligonucleotide
ugcuauuagucaauaauaucccuguua

SEQ ID NO: 4856 - RNA, 27 nt, Artificial Sequence
  Synthetic oligonucleotide
cugcuauuagucaauaauaucccuguu

SEQ ID NO: 4857 - RNA, 27 nt, Artificial Sequence
  Synthetic oligonucleotide
ucugcuauuagucaauaauaucccugu

SEQ ID NO: 4858 - RNA, 27 nt, Artificial Sequence
  Synthetic oligonucleotide
cucugcuauuagucaauaauaucccug

SEQ ID NO: 4859 - RNA, 27 nt, Artificial Sequence
  Synthetic oligonucleotide
ccucugcuauuagucaauaauaucccu

SEQ ID NO: 4860 - RNA, 27 nt, Artificial Sequence
  Synthetic oligonucleotide
uccucugcuauuagucaauaauauccc

SEQ ID NO: 4861 - RNA, 27 nt, Artificial Sequence
  Synthetic oligonucleotide
auccucugcuauuagucaauaauaucc

SEQ ID NO: 4862 - RNA, 27 nt, Artificial Sequence
  Synthetic oligonucleotide
cauccucugcuauuagucaauaauauc

SEQ ID NO: 4863 - RNA, 27 nt, Artificial Sequence
  Synthetic oligonucleotide
acauccucugcuauuagucaauaauau

SEQ ID NO: 4864 - RNA, 27 nt, Artificial Sequence
  Synthetic oligonucleotide
uacauccucugcuauuagucaauaaua

SEQ ID NO: 4865 - RNA, 27 nt, Artificial Sequence
  Synthetic oligonucleotide
uuacauccucugcuauuagucaauaau

SEQ ID NO: 4866 - RNA, 27 nt, Artificial Sequence
  Synthetic oligonucleotide
auuacauccucugcuauuagucaauaa

SEQ ID NO: 4867 - RNA, 27 nt, Artificial Sequence
  Synthetic oligonucleotide
uauuacauccucugcuauuagucaaua

SEQ ID NO: 4868 - RNA, 27 nt, Artificial Sequence
  Synthetic oligonucleotide
cuauuacauccucugcuauuagucaau

SEQ ID NO: 4869 - RNA, 27 nt, Artificial Sequence
  Synthetic oligonucleotide
acuauuacauccucugcuauuagucaa

SEQ ID NO: 4870 - RNA, 27 nt, Artificial Sequence
  Synthetic oligonucleotide
gacuauuacauccucugcuauuaguca

SEQ ID NO: 4871 - RNA, 27 nt, Artificial Sequence
  Synthetic oligonucleotide
ugacuauuacauccucugcuauuaguc

SEQ ID NO: 4872 - RNA, 27 nt, Artificial Sequence
  Synthetic oligonucleotide
uugacuauuacauccucugcuauuagu

SEQ ID NO: 4873 - RNA, 27 nt, Artificial Sequence
  Synthetic oligonucleotide
guugacuauuacauccucugcuauuag

SEQ ID NO: 4874 - RNA, 27 nt, Artificial Sequence
  Synthetic oligonucleotide
aguugacuauuacauccucugcuauua

SEQ ID NO: 4875 - RNA, 27 nt, Artificial Sequence
  Synthetic oligonucleotide
caguugacuauuacauccucugcuauu

SEQ ID NO: 4876 - RNA, 27 nt, Artificial Sequence
  Synthetic oligonucleotide
ucaguugacuauuacauccucugcuau

SEQ ID NO: 4877 - RNA, 27 nt, Artificial Sequence
  Synthetic oligonucleotide
cucaguugacuauuacauccucugcua

SEQ ID NO: 4878 - RNA, 27 nt, Artificial Sequence
  Synthetic oligonucleotide
acucaguugacuauuacauccucugcu

SEQ ID NO: 4879 - RNA, 27 nt, Artificial Sequence
  Synthetic oligonucleotide
aacucaguugacuauuacauccucugc

SEQ ID NO: 4880 - RNA, 27 nt, Artificial Sequence
  Synthetic oligonucleotide
caacucaguugacuauuacauccucug

SEQ ID NO: 4881 - RNA, 27 nt, Artificial Sequence
  Synthetic oligonucleotide
acaacucaguugacuauuacauccucu

SEQ ID NO: 4882 - RNA, 27 nt, Artificial Sequence
  Synthetic oligonucleotide
uacaacucaguugacuauuacauccuc

SEQ ID NO: 4883 - RNA, 27 nt, Artificial Sequence
  Synthetic oligonucleotide
auacaacucaguugacuauuacauccu

SEQ ID NO: 4884 - RNA, 27 nt, Artificial Sequence
  Synthetic oligonucleotide
aauacaacucaguugacuauuacaucc

SEQ ID NO: 4885 - RNA, 27 nt, Artificial Sequence
  Synthetic oligonucleotide
caauacaacucaguugacuauuacauc

SEQ ID NO: 4886 - RNA, 27 nt, Artificial Sequence
  Synthetic oligonucleotide
ccaauacaacucaguugacuauuacau

SEQ ID NO: 4887 - RNA, 27 nt, Artificial Sequence
  Synthetic oligonucleotide
accaauacaacucaguugacuauuaca

SEQ ID NO: 4888 - RNA, 27 nt, Artificial Sequence
  Synthetic oligonucleotide
uaccaauacaacucaguugacuauuac

SEQ ID NO: 4889 - RNA, 27 nt, Artificial Sequence
  Synthetic oligonucleotide
guaccaauacaacucaguugacuauua

SEQ ID NO: 4890 - RNA, 27 nt, Artificial Sequence
  Synthetic oligonucleotide
gguaccaauacaacucaguugacuauu

SEQ ID NO: 4891 - RNA, 27 nt, Artificial Sequence
  Synthetic oligonucleotide
ugguaccaauacaacucaguugacuau

SEQ ID NO: 4892 - RNA, 27 nt, Artificial Sequence
  Synthetic oligonucleotide
gugguaccaauacaacucaguugacua

SEQ ID NO: 4893 - RNA, 27 nt, Artificial Sequence
  Synthetic oligonucleotide
agugguaccaauacaacucaguugacu

SEQ ID NO: 4894 - RNA, 27 nt, Artificial Sequence
  Synthetic oligonucleotide
aagugguaccaauacaacucaguugac

SEQ ID NO: 4895 - RNA, 27 nt, Artificial Sequence
  Synthetic oligonucleotide
gaagugguaccaauacaacucaguuga

SEQ ID NO: 4896 - RNA, 27 nt, Artificial Sequence
  Synthetic oligonucleotide
ggaagugguaccaauacaacucaguug

SEQ ID NO: 4897 - RNA, 27 nt, Artificial Sequence
  Synthetic oligonucleotide
uggaagugguaccaauacaacucaguu

SEQ ID NO: 4898 - RNA, 27 nt, Artificial Sequence
  Synthetic oligonucleotide
auggaagugguaccaauacaacucagu

SEQ ID NO: 4899 - RNA, 27 nt, Artificial Sequence
  Synthetic oligonucleotide
aauggaagugguaccaauacaacucag

SEQ ID NO: 4900 - RNA, 27 nt, Artificial Sequence
  Synthetic oligonucleotide
caauggaagugguaccaauacaacuca

SEQ ID NO: 4901 - RNA, 27 nt, Artificial Sequence
  Synthetic oligonucleotide
acaauggaagugguaccaauacaacuc

SEQ ID NO: 4902 - RNA, 27 nt, Artificial Sequence
  Synthetic oligonucleotide
uacaauggaagugguaccaauacaacu

SEQ ID NO: 4903 - RNA, 27 nt, Artificial Sequence
  Synthetic oligonucleotide
uuacaauggaagugguaccaauacaac

SEQ ID NO: 4904 - RNA, 27 nt, Artificial Sequence
  Synthetic oligonucleotide
cuuacaauggaagugguaccaauacaa

SEQ ID NO: 4905 - RNA, 27 nt, Artificial Sequence
  Synthetic oligonucleotide
acuuacaauggaagugguaccaauaca

SEQ ID NO: 4906 - RNA, 27 nt, Artificial Sequence
  Synthetic oligonucleotide
gacuuacaauggaagugguaccaauac

SEQ ID NO: 4907 - RNA, 27 nt, Artificial Sequence
  Synthetic oligonucleotide
ggacuuacaauggaagugguaccaaua

SEQ ID NO: 4908 - RNA, 27 nt, Artificial Sequence
  Synthetic oligonucleotide
gggacuuacaauggaagugguaccaau

SEQ ID NO: 4909 - RNA, 27 nt, Artificial Sequence
  Synthetic oligonucleotide
ugggacuuacaauggaagugguaccaa

SEQ ID NO: 4910 - RNA, 27 nt, Artificial Sequence
  Synthetic oligonucleotide
uugggacuuacaauggaagugguacca

SEQ ID NO: 4911 - RNA, 27 nt, Artificial Sequence
  Synthetic oligonucleotide
uuugggacuuacaauggaagugguacc

SEQ ID NO: 4912 - RNA, 27 nt, Artificial Sequence
  Synthetic oligonucleotide
cuuugggacuuacaauggaagugguac

SEQ ID NO: 4913 - RNA, 27 nt, Artificial Sequence
  Synthetic oligonucleotide
acuuugggacuuacaauggaaguggua

SEQ ID NO: 4914 - RNA, 27 nt, Artificial Sequence
  Synthetic oligonucleotide
uacuuugggacuuacaauggaaguggu

SEQ ID NO: 4915 - RNA, 27 nt, Artificial Sequence
  Synthetic oligonucleotide
auacuuugggacuuacaauggaagugg

SEQ ID NO: 4916 - RNA, 27 nt, Artificial Sequence
  Synthetic oligonucleotide
aauacuuugggacuuacaauggaagug

SEQ ID NO: 4917 - RNA, 27 nt, Artificial Sequence
  Synthetic oligonucleotide
uaauacuuugggacuuacaauggaagu

SEQ ID NO: 4918 - RNA, 27 nt, Artificial Sequence
  Synthetic oligonucleotide
auaauacuuugggacuuacaauggaag

SEQ ID NO: 4919 - RNA, 27 nt, Artificial Sequence
  Synthetic oligonucleotide
uauaauacuuugggacuuacaauggaa

SEQ ID NO: 4920 - RNA, 27 nt, Artificial Sequence
  Synthetic oligonucleotide
auauaauacuuugggacuuacaaugga

SEQ ID NO: 4921 - RNA, 27 nt, Artificial Sequence
  Synthetic oligonucleotide
uauauaauacuuugggacuuacaaugg

SEQ ID NO: 4922 - RNA, 27 nt, Artificial Sequence
  Synthetic oligonucleotide
auauauaauacuuugggacuuacaaug

SEQ ID NO: 4923 - RNA, 27 nt, Artificial Sequence
  Synthetic oligonucleotide
aauauauaauacuuugggacuuacaau

SEQ ID NO: 4924 - RNA, 27 nt, Artificial Sequence
  Synthetic oligonucleotide
aaauauauaauacuuugggacuuacaa

SEQ ID NO: 4925 - RNA, 27 nt, Artificial Sequence
  Synthetic oligonucleotide
caaauauauaauacuuugggacuuaca

SEQ ID NO: 4926 - RNA, 27 nt, Artificial Sequence
  Synthetic oligonucleotide
ucaaauauauaauacuuugggacuuac

SEQ ID NO: 4927 - RNA, 27 nt, Artificial Sequence
  Synthetic oligonucleotide
aucaaauauauaauacuuugggacuua

SEQ ID NO: 4928 - RNA, 27 nt, Artificial Sequence
  Synthetic oligonucleotide
uaucaaauauauaauacuuugggacuu

SEQ ID NO: 4929 - RNA, 27 nt, Artificial Sequence
  Synthetic oligonucleotide
uuaucaaauauauaauacuuugggacu

SEQ ID NO: 4930 - RNA, 27 nt, Artificial Sequence
  Synthetic oligonucleotide
auuaucaaauauauaauacuuugggac

SEQ ID NO: 4931 - RNA, 27 nt, Artificial Sequence
  Synthetic oligonucleotide
uauuaucaaauauauaauacuuuggga

SEQ ID NO: 4932 - RNA, 27 nt, Artificial Sequence
  Synthetic oligonucleotide
uuauuaucaaauauauaauacuuuggg

SEQ ID NO: 4933 - RNA, 27 nt, Artificial Sequence
  Synthetic oligonucleotide
auuauuaucaaauauauaauacuuugg

SEQ ID NO: 4934 - RNA, 27 nt, Artificial Sequence
  Synthetic oligonucleotide
cauuauuaucaaauauauaauacuuug

SEQ ID NO: 4935 - RNA, 27 nt, Artificial Sequence
  Synthetic oligonucleotide
gcauuauuaucaaauauauaauacuuu

SEQ ID NO: 4936 - RNA, 27 nt, Artificial Sequence
  Synthetic oligonucleotide
agcauuauuaucaaauauauaauacuu

SEQ ID NO: 4937 - RNA, 27 nt, Artificial Sequence
  Synthetic oligonucleotide
uagcauuauuaucaaauauauaauacu

SEQ ID NO: 4938 - RNA, 27 nt, Artificial Sequence
  Synthetic oligonucleotide
uuagcauuauuaucaaauauauaauac

SEQ ID NO: 4939 - RNA, 27 nt, Artificial Sequence
  Synthetic oligonucleotide
auuagcauuauuaucaaauauauaaua

SEQ ID NO: 4940 - RNA, 27 nt, Artificial Sequence
  Synthetic oligonucleotide
gauuagcauuauuaucaaauauauaau

SEQ ID NO: 4941 - RNA, 27 nt, Artificial Sequence
  Synthetic oligonucleotide
ugauuagcauuauuaucaaauauauaa

SEQ ID NO: 4942 - RNA, 27 nt, Artificial Sequence
  Synthetic oligonucleotide
augauuagcauuauuaucaaauauaua

SEQ ID NO: 4943 - RNA, 27 nt, Artificial Sequence
  Synthetic oligonucleotide
uaugauuagcauuauuaucaaauauau

SEQ ID NO: 4944 - RNA, 27 nt, Artificial Sequence
  Synthetic oligonucleotide
uuaugauuagcauuauuaucaaauaua

SEQ ID NO: 4945 - RNA, 27 nt, Artificial Sequence
  Synthetic oligonucleotide
auuaugauuagcauuauuaucaaauau

SEQ ID NO: 4946 - RNA, 27 nt, Artificial Sequence
  Synthetic oligonucleotide
aauuaugauuagcauuauuaucaaaua

SEQ ID NO: 4947 - RNA, 27 nt, Artificial Sequence
  Synthetic oligonucleotide
caauuaugauuagcauuauuaucaaau

SEQ ID NO: 4948 - RNA, 27 nt, Artificial Sequence
  Synthetic oligonucleotide
ccaauuaugauuagcauuauuaucaaa

SEQ ID NO: 4949 - RNA, 27 nt, Artificial Sequence
  Synthetic oligonucleotide
uccaauuaugauuagcauuauuaucaa

SEQ ID NO: 4950 - RNA, 27 nt, Artificial Sequence
  Synthetic oligonucleotide
uuccaauuaugauuagcauuauuauca

SEQ ID NO: 4951 - RNA, 27 nt, Artificial Sequence
  Synthetic oligonucleotide
uuuccaauuaugauuagcauuauuauc

SEQ ID NO: 4952 - RNA, 27 nt, Artificial Sequence
  Synthetic oligonucleotide
cuuuccaauuaugauuagcauuauuau

SEQ ID NO: 4953 - RNA, 27 nt, Artificial Sequence
  Synthetic oligonucleotide
acuuuccaauuaugauuagcauuauua

SEQ ID NO: 4954 - RNA, 27 nt, Artificial Sequence
  Synthetic oligonucleotide
uacuuuccaauuaugauuagcauuauu

SEQ ID NO: 4955 - RNA, 27 nt, Artificial Sequence
  Synthetic oligonucleotide
uuacuuuccaauuaugauuagcauuau

SEQ ID NO: 4956 - RNA, 27 nt, Artificial Sequence
  Synthetic oligonucleotide
guuacuuuccaauuaugauuagcauua

SEQ ID NO: 4957 - RNA, 27 nt, Artificial Sequence
  Synthetic oligonucleotide
uguuacuuuccaauuaugauuagcauu

SEQ ID NO: 4958 - RNA, 27 nt, Artificial Sequence
  Synthetic oligonucleotide
auguuacuuuccaauuaugauuagcau

SEQ ID NO: 4959 - RNA, 27 nt, Artificial Sequence
  Synthetic oligonucleotide
aauguuacuuuccaauuaugauuagca

SEQ ID NO: 4960 - RNA, 27 nt, Artificial Sequence
  Synthetic oligonucleotide
gaauguuacuuuccaauuaugauuagc

SEQ ID NO: 4961 - RNA, 27 nt, Artificial Sequence
  Synthetic oligonucleotide
agaauguuacuuuccaauuaugauuag

SEQ ID NO: 4962 - RNA, 27 nt, Artificial Sequence
  Synthetic oligonucleotide
uagaauguuacuuuccaauuaugauua

SEQ ID NO: 4963 - RNA, 27 nt, Artificial Sequence
  Synthetic oligonucleotide
auagaauguuacuuuccaauuaugauu

SEQ ID NO: 4964 - RNA, 27 nt, Artificial Sequence
  Synthetic oligonucleotide
uauagaauguuacuuuccaauuaugau

SEQ ID NO: 4965 - RNA, 27 nt, Artificial Sequence
  Synthetic oligonucleotide
auauagaauguuacuuuccaauuauga

SEQ ID NO: 4966 - RNA, 27 nt, Artificial Sequence
  Synthetic oligonucleotide
cauauagaauguuacuuuccaauuaug

SEQ ID NO: 4967 - RNA, 27 nt, Artificial Sequence
  Synthetic oligonucleotide
acauauagaauguuacuuuccaauuau

SEQ ID NO: 4968 - RNA, 27 nt, Artificial Sequence
  Synthetic oligonucleotide
uacauauagaauguuacuuuccaauua

SEQ ID NO: 4969 - RNA, 27 nt, Artificial Sequence
  Synthetic oligonucleotide
uuacauauagaauguuacuuuccaauu

SEQ ID NO: 4970 - RNA, 27 nt, Artificial Sequence
  Synthetic oligonucleotide
uuuacauauagaauguuacuuuccaau

SEQ ID NO: 4971 - RNA, 27 nt, Artificial Sequence
  Synthetic oligonucleotide
auuuacauauagaauguuacuuuccaa

SEQ ID NO: 4972 - RNA, 27 nt, Artificial Sequence
  Synthetic oligonucleotide
cauuuacauauagaauguuacuuucca

SEQ ID NO: 4973 - RNA, 27 nt, Artificial Sequence
  Synthetic oligonucleotide
acauuuacauauagaauguuacuuucc

SEQ ID NO: 4974 - RNA, 27 nt, Artificial Sequence
  Synthetic oligonucleotide
uacauuuacauauagaauguuacuuuc

SEQ ID NO: 4975 - RNA, 27 nt, Artificial Sequence
  Synthetic oligonucleotide
uuacauuuacauauagaauguuacuuu

SEQ ID NO: 4976 - RNA, 27 nt, Artificial Sequence
  Synthetic oligonucleotide
uuuacauuuacauauagaauguuacuu

SEQ ID NO: 4977 - RNA, 27 nt, Artificial Sequence
  Synthetic oligonucleotide
uuuuacauuuacauauagaauguuacu

SEQ ID NO: 4978 - RNA, 27 nt, Artificial Sequence
  Synthetic oligonucleotide
auuuuacauuuacauauagaauguuac

SEQ ID NO: 4979 - RNA, 27 nt, Artificial Sequence
  Synthetic oligonucleotide
aauuuuacauuuacauauagaauguua

SEQ ID NO: 4980 - RNA, 27 nt, Artificial Sequence
  Synthetic oligonucleotide
aaauuuuacauuuacauauagaauguu

SEQ ID NO: 4981 - RNA, 27 nt, Artificial Sequence
  Synthetic oligonucleotide
uaaauuuuacauuuacauauagaaugu

SEQ ID NO: 4982 - RNA, 27 nt, Artificial Sequence
  Synthetic oligonucleotide
auaaauuuuacauuuacauauagaaug

SEQ ID NO: 4983 - RNA, 27 nt, Artificial Sequence
  Synthetic oligonucleotide
aauaaauuuuacauuuacauauagaau

SEQ ID NO: 4984 - RNA, 27 nt, Artificial Sequence
  Synthetic oligonucleotide
aaauaaauuuuacauuuacauauagaa

SEQ ID NO: 4985 - RNA, 27 nt, Artificial Sequence
  Synthetic oligonucleotide
caaauaaauuuuacauuuacauauaga

SEQ ID NO: 4986 - RNA, 27 nt, Artificial Sequence
  Synthetic oligonucleotide
gcaaauaaauuuuacauuuacauauag

SEQ ID NO: 4987 - RNA, 27 nt, Artificial Sequence
  Synthetic oligonucleotide
ggcaaauaaauuuuacauuuacauaua

SEQ ID NO: 4988 - RNA, 27 nt, Artificial Sequence
  Synthetic oligonucleotide
uggcaaauaaauuuuacauuuacauau

SEQ ID NO: 4989 - RNA, 27 nt, Artificial Sequence
  Synthetic oligonucleotide
uuggcaaauaaauuuuacauuuacaua

SEQ ID NO: 4990 - RNA, 27 nt, Artificial Sequence
  Synthetic oligonucleotide
guuggcaaauaaauuuuacauuuacau

SEQ ID NO: 4991 - RNA, 27 nt, Artificial Sequence
  Synthetic oligonucleotide
aguuggcaaauaaauuuuacauuuaca

SEQ ID NO: 4992 - RNA, 27 nt, Artificial Sequence
  Synthetic oligonucleotide
caguuggcaaauaaauuuuacauuuac

SEQ ID NO: 4993 - RNA, 27 nt, Artificial Sequence
  Synthetic oligonucleotide
ucaguuggcaaauaaauuuuacauuua

SEQ ID NO: 4994 - RNA, 27 nt, Artificial Sequence
  Synthetic oligonucleotide
uucaguuggcaaauaaauuuuacauuu

SEQ ID NO: 4995 - RNA, 27 nt, Artificial Sequence
  Synthetic oligonucleotide
auucaguuggcaaauaaauuuuacauu

SEQ ID NO: 4996 - RNA, 27 nt, Artificial Sequence
  Synthetic oligonucleotide
uauucaguuggcaaauaaauuuuacau

SEQ ID NO: 4997 - RNA, 27 nt, Artificial Sequence
  Synthetic oligonucleotide
auauucaguuggcaaauaaauuuuaca

SEQ ID NO: 4998 - RNA, 27 nt, Artificial Sequence
  Synthetic oligonucleotide
uauauucaguuggcaaauaaauuuuac

SEQ ID NO: 4999 - RNA, 27 nt, Artificial Sequence
  Synthetic oligonucleotide
cuauauucaguuggcaaauaaauuuua

SEQ ID NO: 5000 - RNA, 27 nt, Artificial Sequence
  Synthetic oligonucleotide
ccuauauucaguuggcaaauaaauuuu

SEQ ID NO: 5001 - RNA, 27 nt, Artificial Sequence
  Synthetic oligonucleotide
gccuauauucaguuggcaaauaaauuu

SEQ ID NO: 5002 - RNA, 27 nt, Artificial Sequence
  Synthetic oligonucleotide
ugccuauauucaguuggcaaauaaauu

SEQ ID NO: 5003 - RNA, 27 nt, Artificial Sequence
  Synthetic oligonucleotide
uugccuauauucaguuggcaaauaaau

SEQ ID NO: 5004 - RNA, 27 nt, Artificial Sequence
  Synthetic oligonucleotide
auugccuauauucaguuggcaaauaaa

SEQ ID NO: 5005 - RNA, 27 nt, Artificial Sequence
  Synthetic oligonucleotide
cauugccuauauucaguuggcaaauaa

SEQ ID NO: 5006 - RNA, 27 nt, Artificial Sequence
  Synthetic oligonucleotide
ucauugccuauauucaguuggcaaaua

SEQ ID NO: 5007 - RNA, 27 nt, Artificial Sequence
  Synthetic oligonucleotide
aucauugccuauauucaguuggcaaau

SEQ ID NO: 5008 - RNA, 27 nt, Artificial Sequence
  Synthetic oligonucleotide
uaucauugccuauauucaguuggcaaa

SEQ ID NO: 5009 - RNA, 27 nt, Artificial Sequence
  Synthetic oligonucleotide
cuaucauugccuauauucaguuggcaa

SEQ ID NO: 5010 - RNA, 27 nt, Artificial Sequence
  Synthetic oligonucleotide
acuaucauugccuauauucaguuggca

SEQ ID NO: 5011 - RNA, 27 nt, Artificial Sequence
  Synthetic oligonucleotide
cacuaucauugccuauauucaguuggc

SEQ ID NO: 5012 - RNA, 27 nt, Artificial Sequence
  Synthetic oligonucleotide
acacuaucauugccuauauucaguugg

SEQ ID NO: 5013 - RNA, 27 nt, Artificial Sequence
  Synthetic oligonucleotide
cacacuaucauugccuauauucaguug

SEQ ID NO: 5014 - RNA, 27 nt, Artificial Sequence
  Synthetic oligonucleotide
acacacuaucauugccuauauucaguu

SEQ ID NO: 5015 - RNA, 27 nt, Artificial Sequence
  Synthetic oligonucleotide
gacacacuaucauugccuauauucagu

SEQ ID NO: 5016 - RNA, 27 nt, Artificial Sequence
  Synthetic oligonucleotide
ugacacacuaucauugccuauauucag

SEQ ID NO: 5017 - RNA, 27 nt, Artificial Sequence
  Synthetic oligonucleotide
gugacacacuaucauugccuauauuca

SEQ ID NO: 5018 - RNA, 27 nt, Artificial Sequence
  Synthetic oligonucleotide
agugacacacuaucauugccuauauuc

SEQ ID NO: 5019 - RNA, 27 nt, Artificial Sequence
  Synthetic oligonucleotide
uagugacacacuaucauugccuauauu

SEQ ID NO: 5020 - RNA, 27 nt, Artificial Sequence
  Synthetic oligonucleotide
auagugacacacuaucauugccuauau

SEQ ID NO: 5021 - RNA, 27 nt, Artificial Sequence
  Synthetic oligonucleotide
uauagugacacacuaucauugccuaua

SEQ ID NO: 5022 - RNA, 27 nt, Artificial Sequence
  Synthetic oligonucleotide
cuauagugacacacuaucauugccuau

SEQ ID NO: 5023 - RNA, 27 nt, Artificial Sequence
  Synthetic oligonucleotide
ccuauagugacacacuaucauugccua

SEQ ID NO: 5024 - RNA, 27 nt, Artificial Sequence
  Synthetic oligonucleotide
cccuauagugacacacuaucauugccu

SEQ ID NO: 5025 - RNA, 27 nt, Artificial Sequence
  Synthetic oligonucleotide
ucccuauagugacacacuaucauugcc

SEQ ID NO: 5026 - RNA, 27 nt, Artificial Sequence
  Synthetic oligonucleotide
uucccuauagugacacacuaucauugc

SEQ ID NO: 5027 - RNA, 27 nt, Artificial Sequence
  Synthetic oligonucleotide
guucccuauagugacacacuaucauug

SEQ ID NO: 5028 - RNA, 27 nt, Artificial Sequence
  Synthetic oligonucleotide
uguucccuauagugacacacuaucauu

SEQ ID NO: 5029 - RNA, 27 nt, Artificial Sequence
  Synthetic oligonucleotide
guguucccuauagugacacacuaucau

SEQ ID NO: 5030 - RNA, 27 nt, Artificial Sequence
  Synthetic oligonucleotide
uguguucccuauagugacacacuauca

SEQ ID NO: 5031 - RNA, 27 nt, Artificial Sequence
  Synthetic oligonucleotide
cuguguucccuauagugacacacuauc

SEQ ID NO: 5032 - RNA, 27 nt, Artificial Sequence
  Synthetic oligonucleotide
ucuguguucccuauagugacacacuau

SEQ ID NO: 5033 - RNA, 27 nt, Artificial Sequence
  Synthetic oligonucleotide
aucuguguucccuauagugacacacua

SEQ ID NO: 5034 - RNA, 27 nt, Artificial Sequence
  Synthetic oligonucleotide
aaucuguguucccuauagugacacacu

SEQ ID NO: 5035 - RNA, 27 nt, Artificial Sequence
  Synthetic oligonucleotide
aaaucuguguucccuauagugacacac

SEQ ID NO: 5036 - RNA, 27 nt, Artificial Sequence
  Synthetic oligonucleotide
aaaaucuguguucccuauagugacaca

SEQ ID NO: 5037 - RNA, 27 nt, Artificial Sequence
  Synthetic oligonucleotide
aaaaaucuguguucccuauagugacac

SEQ ID NO: 5038 - RNA, 27 nt, Artificial Sequence
  Synthetic oligonucleotide
caaaaaucuguguucccuauagugaca

SEQ ID NO: 5039 - RNA, 27 nt, Artificial Sequence
  Synthetic oligonucleotide
ucaaaaaucuguguucccuauagugac

SEQ ID NO: 5040 - RNA, 27 nt, Artificial Sequence
  Synthetic oligonucleotide
cucaaaaaucuguguucccuauaguga

SEQ ID NO: 5041 - RNA, 27 nt, Artificial Sequence
  Synthetic oligonucleotide
ucucaaaaaucuguguucccuauagug

SEQ ID NO: 5042 - RNA, 27 nt, Artificial Sequence
  Synthetic oligonucleotide
aucucaaaaaucuguguucccuauagu

SEQ ID NO: 5043 - RNA, 27 nt, Artificial Sequence
  Synthetic oligonucleotide
gaucucaaaaaucuguguucccuauag

SEQ ID NO: 5044 - RNA, 27 nt, Artificial Sequence
  Synthetic oligonucleotide
agaucucaaaaaucuguguucccuaua

SEQ ID NO: 5045 - RNA, 27 nt, Artificial Sequence
  Synthetic oligonucleotide
aagaucucaaaaaucuguguucccuau

SEQ ID NO: 5046 - RNA, 27 nt, Artificial Sequence
  Synthetic oligonucleotide
caagaucucaaaaaucuguguucccua

SEQ ID NO: 5047 - RNA, 27 nt, Artificial Sequence
  Synthetic oligonucleotide
acaagaucucaaaaaucuguguucccu

SEQ ID NO: 5048 - RNA, 27 nt, Artificial Sequence
  Synthetic oligonucleotide
gacaagaucucaaaaaucuguguuccc

SEQ ID NO: 5049 - RNA, 27 nt, Artificial Sequence
  Synthetic oligonucleotide
ggacaagaucucaaaaaucuguguucc

SEQ ID NO: 5050 - RNA, 27 nt, Artificial Sequence
  Synthetic oligonucleotide
aggacaagaucucaaaaaucuguguuc

SEQ ID NO: 5051 - RNA, 27 nt, Artificial Sequence
  Synthetic oligonucleotide
gaggacaagaucucaaaaaucuguguu

SEQ ID NO: 5052 - RNA, 27 nt, Artificial Sequence
  Synthetic oligonucleotide
agaggacaagaucucaaaaaucugugu

SEQ ID NO: 5053 - RNA, 27 nt, Artificial Sequence
  Synthetic oligonucleotide
cagaggacaagaucucaaaaaucugug

SEQ ID NO: 5054 - RNA, 27 nt, Artificial Sequence
  Synthetic oligonucleotide
ccagaggacaagaucucaaaaaucugu

SEQ ID NO: 5055 - RNA, 27 nt, Artificial Sequence
  Synthetic oligonucleotide
uccagaggacaagaucucaaaaaucug

SEQ ID NO: 5056 - RNA, 27 nt, Artificial Sequence
  Synthetic oligonucleotide
uuccagaggacaagaucucaaaaaucu

SEQ ID NO: 5057 - RNA, 27 nt, Artificial Sequence
  Synthetic oligonucleotide
cuuccagaggacaagaucucaaaaauc

SEQ ID NO: 5058 - RNA, 27 nt, Artificial Sequence
  Synthetic oligonucleotide
gcuuccagaggacaagaucucaaaaau

SEQ ID NO: 5059 - RNA, 27 nt, Artificial Sequence
  Synthetic oligonucleotide
agcuuccagaggacaagaucucaaaaa

SEQ ID NO: 5060 - RNA, 27 nt, Artificial Sequence
  Synthetic oligonucleotide
cagcuuccagaggacaagaucucaaaa

SEQ ID NO: 5061 - RNA, 27 nt, Artificial Sequence
  Synthetic oligonucleotide
ccagcuuccagaggacaagaucucaaa

SEQ ID NO: 5062 - RNA, 27 nt, Artificial Sequence
  Synthetic oligonucleotide
accagcuuccagaggacaagaucucaa

SEQ ID NO: 5063 - RNA, 27 nt, Artificial Sequence
  Synthetic oligonucleotide
uaccagcuuccagaggacaagaucuca

SEQ ID NO: 5064 - RNA, 27 nt, Artificial Sequence
  Synthetic oligonucleotide
uuaccagcuuccagaggacaagaucuc

SEQ ID NO: 5065 - RNA, 27 nt, Artificial Sequence
  Synthetic oligonucleotide
guuaccagcuuccagaggacaagaucu

SEQ ID NO: 5066 - RNA, 27 nt, Artificial Sequence
  Synthetic oligonucleotide
uguuaccagcuuccagaggacaagauc

SEQ ID NO: 5067 - RNA, 27 nt, Artificial Sequence
  Synthetic oligonucleotide
uuguuaccagcuuccagaggacaagau

SEQ ID NO: 5068 - RNA, 27 nt, Artificial Sequence
  Synthetic oligonucleotide
auuguuaccagcuuccagaggacaaga

SEQ ID NO: 5069 - RNA, 27 nt, Artificial Sequence
  Synthetic oligonucleotide
aauuguuaccagcuuccagaggacaag

SEQ ID NO: 5070 - RNA, 27 nt, Artificial Sequence
  Synthetic oligonucleotide
uaauuguuaccagcuuccagaggacaa

SEQ ID NO: 5071 - RNA, 27 nt, Artificial Sequence
  Synthetic oligonucleotide
uuaauuguuaccagcuuccagaggaca

SEQ ID NO: 5072 - RNA, 27 nt, Artificial Sequence
  Synthetic oligonucleotide
uuuaauuguuaccagcuuccagaggac

SEQ ID NO: 5073 - RNA, 27 nt, Artificial Sequence
  Synthetic oligonucleotide
uuuuaauuguuaccagcuuccagagga

SEQ ID NO: 5074 - RNA, 27 nt, Artificial Sequence
  Synthetic oligonucleotide
uuuuuaauuguuaccagcuuccagagg

SEQ ID NO: 5075 - RNA, 27 nt, Artificial Sequence
  Synthetic oligonucleotide
guuuuuaauuguuaccagcuuccagag

SEQ ID NO: 5076 - RNA, 27 nt, Artificial Sequence
  Synthetic oligonucleotide
uguuuuuaauuguuaccagcuuccaga

SEQ ID NO: 5077 - RNA, 27 nt, Artificial Sequence
  Synthetic oligonucleotide
uuguuuuuaauuguuaccagcuuccag

SEQ ID NO: 5078 - RNA, 27 nt, Artificial Sequence
  Synthetic oligonucleotide
auuguuuuuaauuguuaccagcuucca

SEQ ID NO: 5079 - RNA, 27 nt, Artificial Sequence
  Synthetic oligonucleotide
gauuguuuuuaauuguuaccagcuucc

SEQ ID NO: 5080 - RNA, 27 nt, Artificial Sequence
  Synthetic oligonucleotide
agauuguuuuuaauuguuaccagcuuc

SEQ ID NO: 5081 - RNA, 27 nt, Artificial Sequence
  Synthetic oligonucleotide
aagauuguuuuuaauuguuaccagcuu

SEQ ID NO: 5082 - RNA, 27 nt, Artificial Sequence
  Synthetic oligonucleotide
uaagauuguuuuuaauuguuaccagcu

SEQ ID NO: 5083 - RNA, 27 nt, Artificial Sequence
  Synthetic oligonucleotide
uuaagauuguuuuuaauuguuaccagc

SEQ ID NO: 5084 - RNA, 27 nt, Artificial Sequence
  Synthetic oligonucleotide
cuuaagauuguuuuuaauuguuaccag

SEQ ID NO: 5085 - RNA, 27 nt, Artificial Sequence
  Synthetic oligonucleotide
ccuuaagauuguuuuuaauuguuacca

SEQ ID NO: 5086 - RNA, 27 nt, Artificial Sequence
  Synthetic oligonucleotide
gccuuaagauuguuuuuaauuguuacc

SEQ ID NO: 5087 - RNA, 27 nt, Artificial Sequence
  Synthetic oligonucleotide
ugccuuaagauuguuuuuaauuguuac

SEQ ID NO: 5088 - RNA, 27 nt, Artificial Sequence
  Synthetic oligonucleotide
cugccuuaagauuguuuuuaauuguua

SEQ ID NO: 5089 - RNA, 27 nt, Artificial Sequence
  Synthetic oligonucleotide
ccugccuuaagauuguuuuuaauuguu

SEQ ID NO: 5090 - RNA, 27 nt, Artificial Sequence
  Synthetic oligonucleotide
cccugccuuaagauuguuuuuaauugu

SEQ ID NO: 5091 - RNA, 27 nt, Artificial Sequence
  Synthetic oligonucleotide
ucccugccuuaagauuguuuuuaauug

SEQ ID NO: 5092 - RNA, 27 nt, Artificial Sequence
  Synthetic oligonucleotide
uucccugccuuaagauuguuuuuaauu

SEQ ID NO: 5093 - RNA, 27 nt, Artificial Sequence
  Synthetic oligonucleotide
uuucccugccuuaagauuguuuuuaau

SEQ ID NO: 5094 - RNA, 27 nt, Artificial Sequence
  Synthetic oligonucleotide
uuuucccugccuuaagauuguuuuuaa

SEQ ID NO: 5095 - RNA, 27 nt, Artificial Sequence
  Synthetic oligonucleotide
uuuuucccugccuuaagauuguuuuua

SEQ ID NO: 5096 - RNA, 27 nt, Artificial Sequence
  Synthetic oligonucleotide
uuuuuucccugccuuaagauuguuuuu

SEQ ID NO: 5097 - RNA, 27 nt, Artificial Sequence
  Synthetic oligonucleotide
uuuuuuucccugccuuaagauuguuuu

SEQ ID NO: 5098 - RNA, 27 nt, Artificial Sequence
  Synthetic oligonucleotide
uuuuuuuucccugccuuaagauuguuu

SEQ ID NO: 5099 - RNA, 27 nt, Artificial Sequence
  Synthetic oligonucleotide
uuuuuuuuucccugccuuaagauuguu

SEQ ID NO: 5100 - RNA, 27 nt, Artificial Sequence
  Synthetic oligonucleotide
uuuuuuuuuucccugccuuaagauugu

SEQ ID NO: 5101 - RNA, 27 nt, Artificial Sequence
  Synthetic oligonucleotide
uuuuuuuuuuucccugccuuaagauug

SEQ ID NO: 5102 - RNA, 27 nt, Artificial Sequence
  Synthetic oligonucleotide
uuuuuuuuuuuucccugccuuaagauu

SEQ ID NO: 5103 - RNA, 27 nt, Artificial Sequence
  Synthetic oligonucleotide
uuuuuuuuuuuuucccugccuuaagau

SEQ ID NO: 5104 - RNA, 27 nt, Artificial Sequence
  Synthetic oligonucleotide
uuuuuuuuuuuuuucccugccuuaaga

SEQ ID NO: 5105 - RNA, 27 nt, Artificial Sequence
  Synthetic oligonucleotide
uuuuuuuuuuuuuuucccugccuuaag

SEQ ID NO: 5106 - RNA, 27 nt, Artificial Sequence
  Synthetic oligonucleotide
uuuuuuuuuuuuuuuucccugccuuaa

SEQ ID NO: 5107 - RNA, 27 nt, Artificial Sequence
  Synthetic oligonucleotide
uuuuuuuuuuuuuuuuucccugccuua

SEQ ID NO: 5108 - RNA, 27 nt, Artificial Sequence
  Synthetic oligonucleotide
uuuuuuuuuuuuuuuuuucccugccuu

SEQ ID NO: 5109 - DNA, 27 bp, Artificial Sequence
  Synthetic oligonucleotide
gtctgccggtcggttgtctggctgcgc

SEQ ID NO: 5110 - DNA, 27 bp, Artificial Sequence
  Synthetic oligonucleotide
tctgccggtcggttgtctggctgcgcg

SEQ ID NO: 5111 - DNA, 27 bp, Artificial Sequence
  Synthetic oligonucleotide
ctgccggtcggttgtctggctgcgcgc

SEQ ID NO: 5112 - DNA, 27 bp, Artificial Sequence
  Synthetic oligonucleotide
cggtcggttgtctggctgcgcgcgcca

SEQ ID NO: 5113 - DNA, 27 bp, Artificial Sequence
  Synthetic oligonucleotide
cagtgccccgcctggctcggcatccac

SEQ ID NO: 5114 - DNA, 27 bp, Artificial Sequence
  Synthetic oligonucleotide
ccccgcctggctcggcatccaccccca

SEQ ID NO: 5115 - DNA, 27 bp, Artificial Sequence
  Synthetic oligonucleotide
cccgcctggctcggcatccacccccag

SEQ ID NO: 5116 - DNA, 27 bp, Artificial Sequence
  Synthetic oligonucleotide
cgcctggctcggcatccacccccagcc

SEQ ID NO: 5117 - DNA, 27 bp, Artificial Sequence
  Synthetic oligonucleotide
cctggctcggcatccacccccagcccg

SEQ ID NO: 5118 - DNA, 27 bp, Artificial Sequence
  Synthetic oligonucleotide
ctggctcggcatccacccccagcccga

SEQ ID NO: 5119 - DNA, 27 bp, Artificial Sequence
  Synthetic oligonucleotide
tggctcggcatccacccccagcccgac

SEQ ID NO: 5120 - DNA, 27 bp, Artificial Sequence
  Synthetic oligonucleotide
ggctcggcatccacccccagcccgact

SEQ ID NO: 5121 - DNA, 27 bp, Artificial Sequence
  Synthetic oligonucleotide
gctcggcatccacccccagcccgactc

SEQ ID NO: 5122 - DNA, 27 bp, Artificial Sequence
  Synthetic oligonucleotide
ctcggcatccacccccagcccgactca

SEQ ID NO: 5123 - DNA, 27 bp, Artificial Sequence
  Synthetic oligonucleotide
tcggcatccacccccagcccgactcac

SEQ ID NO: 5124 - DNA, 27 bp, Artificial Sequence
  Synthetic oligonucleotide
cggcatccacccccagcccgactcaca

SEQ ID NO: 5125 - DNA, 27 bp, Artificial Sequence
  Synthetic oligonucleotide
ggcatccacccccagcccgactcacac

SEQ ID NO: 5126 - DNA, 27 bp, Artificial Sequence
  Synthetic oligonucleotide
gcatccacccccagcccgactcacacg

SEQ ID NO: 5127 - DNA, 27 bp, Artificial Sequence
  Synthetic oligonucleotide
catccacccccagcccgactcacacgt

SEQ ID NO: 5128 - DNA, 27 bp, Artificial Sequence
  Synthetic oligonucleotide
atccacccccagcccgactcacacgtg

SEQ ID NO: 5129 - DNA, 27 bp, Artificial Sequence
  Synthetic oligonucleotide
tccacccccagcccgactcacacgtgg

SEQ ID NO: 5130 - DNA, 27 bp, Artificial Sequence
  Synthetic oligonucleotide
ccacccccagcccgactcacacgtggg

SEQ ID NO: 5131 - DNA, 27 bp, Artificial Sequence
  Synthetic oligonucleotide
cacccccagcccgactcacacgtgggt

SEQ ID NO: 5132 - DNA, 27 bp, Artificial Sequence
  Synthetic oligonucleotide
acccccagcccgactcacacgtgggtt

SEQ ID NO: 5133 - DNA, 27 bp, Artificial Sequence
  Synthetic oligonucleotide
cccccagcccgactcacacgtgggttc

SEQ ID NO: 5134 - DNA, 27 bp, Artificial Sequence
  Synthetic oligonucleotide
ccccagcccgactcacacgtgggttcc

SEQ ID NO: 5135 - DNA, 27 bp, Artificial Sequence
  Synthetic oligonucleotide
cccagcccgactcacacgtgggttccc

SEQ ID NO: 5136 - DNA, 27 bp, Artificial Sequence
  Synthetic oligonucleotide
ccagcccgactcacacgtgggttcccg

SEQ ID NO: 5137 - DNA, 27 bp, Artificial Sequence
  Synthetic oligonucleotide
cagcccgactcacacgtgggttcccgc

SEQ ID NO: 5138 - DNA, 27 bp, Artificial Sequence
  Synthetic oligonucleotide
agcccgactcacacgtgggttcccgca

SEQ ID NO: 5139 - DNA, 27 bp, Artificial Sequence
  Synthetic oligonucleotide
gcccgactcacacgtgggttcccgcac

SEQ ID NO: 5140 - DNA, 27 bp, Artificial Sequence
  Synthetic oligonucleotide
cccgactcacacgtgggttcccgcacg

SEQ ID NO: 5141 - DNA, 27 bp, Artificial Sequence
  Synthetic oligonucleotide
ccgactcacacgtgggttcccgcacgt

SEQ ID NO: 5142 - DNA, 27 bp, Artificial Sequence
  Synthetic oligonucleotide
cgactcacacgtgggttcccgcacgtc

SEQ ID NO: 5143 - DNA, 27 bp, Artificial Sequence
  Synthetic oligonucleotide
gactcacacgtgggttcccgcacgtcc

SEQ ID NO: 5144 - DNA, 27 bp, Artificial Sequence
  Synthetic oligonucleotide
actcacacgtgggttcccgcacgtccg

SEQ ID NO: 5145 - DNA, 27 bp, Artificial Sequence
  Synthetic oligonucleotide
ctcacacgtgggttcccgcacgtccgc

SEQ ID NO: 5146 - DNA, 27 bp, Artificial Sequence
  Synthetic oligonucleotide
tcacacgtgggttcccgcacgtccgcc

SEQ ID NO: 5147 - DNA, 27 bp, Artificial Sequence
  Synthetic oligonucleotide
cacacgtgggttcccgcacgtccgccg

SEQ ID NO: 5148 - DNA, 27 bp, Artificial Sequence
  Synthetic oligonucleotide
gccggccccccccgctgacgtcagcat

SEQ ID NO: 5149 - DNA, 27 bp, Artificial Sequence
  Synthetic oligonucleotide
ccggccccccccgctgacgtcagcata

SEQ ID NO: 5150 - DNA, 27 bp, Artificial Sequence
  Synthetic oligonucleotide
cggccccccccgctgacgtcagcatag

SEQ ID NO: 5151 - DNA, 27 bp, Artificial Sequence
  Synthetic oligonucleotide
ggccccccccgctgacgtcagcatagc

SEQ ID NO: 5152 - DNA, 27 bp, Artificial Sequence
  Synthetic oligonucleotide
gccccccccgctgacgtcagcatagct

SEQ ID NO: 5153 - DNA, 27 bp, Artificial Sequence
  Synthetic oligonucleotide
ccccccccgctgacgtcagcatagctg

SEQ ID NO: 5154 - DNA, 27 bp, Artificial Sequence
  Synthetic oligonucleotide
cccccccgctgacgtcagcatagctgt

SEQ ID NO: 5155 - DNA, 27 bp, Artificial Sequence
  Synthetic oligonucleotide
ccccccgctgacgtcagcatagctgtt

SEQ ID NO: 5156 - DNA, 27 bp, Artificial Sequence
  Synthetic oligonucleotide
cccccgctgacgtcagcatagctgttc

SEQ ID NO: 5157 - DNA, 27 bp, Artificial Sequence
  Synthetic oligonucleotide
ccccgctgacgtcagcatagctgttcc

SEQ ID NO: 5158 - DNA, 27 bp, Artificial Sequence
  Synthetic oligonucleotide
cccgctgacgtcagcatagctgttcca

SEQ ID NO: 5159 - DNA, 27 bp, Artificial Sequence
  Synthetic oligonucleotide
ccgctgacgtcagcatagctgttccac

SEQ ID NO: 5160 - DNA, 27 bp, Artificial Sequence
  Synthetic oligonucleotide
cgctgacgtcagcatagctgttccact

SEQ ID NO: 5161 - DNA, 27 bp, Artificial Sequence
  Synthetic oligonucleotide
gctgacgtcagcatagctgttccactt

SEQ ID NO: 5162 - DNA, 27 bp, Artificial Sequence
  Synthetic oligonucleotide
ctgacgtcagcatagctgttccactta

SEQ ID NO: 5163 - DNA, 27 bp, Artificial Sequence
  Synthetic oligonucleotide
tgacgtcagcatagctgttccacttaa

SEQ ID NO: 5164 - DNA, 27 bp, Artificial Sequence
  Synthetic oligonucleotide
gacgtcagcatagctgttccacttaag

SEQ ID NO: 5165 - DNA, 27 bp, Artificial Sequence
  Synthetic oligonucleotide
acgtcagcatagctgttccacttaagg

SEQ ID NO: 5166 - DNA, 27 bp, Artificial Sequence
  Synthetic oligonucleotide
cgtcagcatagctgttccacttaaggc

SEQ ID NO: 5167 - DNA, 27 bp, Artificial Sequence
  Synthetic oligonucleotide
gtcagcatagctgttccacttaaggcc

SEQ ID NO: 5168 - DNA, 27 bp, Artificial Sequence
  Synthetic oligonucleotide
tcagcatagctgttccacttaaggccc

SEQ ID NO: 5169 - DNA, 27 bp, Artificial Sequence
  Synthetic oligonucleotide
cagcatagctgttccacttaaggcccc

SEQ ID NO: 5170 - DNA, 27 bp, Artificial Sequence
  Synthetic oligonucleotide
agcatagctgttccacttaaggcccct

SEQ ID NO: 5171 - DNA, 27 bp, Artificial Sequence
  Synthetic oligonucleotide
gcatagctgttccacttaaggcccctc

SEQ ID NO: 5172 - DNA, 27 bp, Artificial Sequence
  Synthetic oligonucleotide
catagctgttccacttaaggcccctcc

SEQ ID NO: 5173 - DNA, 27 bp, Artificial Sequence
  Synthetic oligonucleotide
atagctgttccacttaaggcccctccc

SEQ ID NO: 5174 - DNA, 27 bp, Artificial Sequence
  Synthetic oligonucleotide
tagctgttccacttaaggcccctcccg

SEQ ID NO: 5175 - DNA, 27 bp, Artificial Sequence
  Synthetic oligonucleotide
agctgttccacttaaggcccctcccgc

SEQ ID NO: 5176 - DNA, 27 bp, Artificial Sequence
  Synthetic oligonucleotide
cccctcccgcgcccagctcagagtgct

SEQ ID NO: 5177 - DNA, 27 bp, Artificial Sequence
  Synthetic oligonucleotide
ctcccgcgcccagctcagagtgctgca

SEQ ID NO: 5178 - DNA, 27 bp, Artificial Sequence
  Synthetic oligonucleotide
tcccgcgcccagctcagagtgctgcag

SEQ ID NO: 5179 - DNA, 27 bp, Artificial Sequence
  Synthetic oligonucleotide
cccgcgcccagctcagagtgctgcagc

SEQ ID NO: 5180 - DNA, 27 bp, Artificial Sequence
  Synthetic oligonucleotide
ccgcgcccagctcagagtgctgcagcc

SEQ ID NO: 5181 - DNA, 27 bp, Artificial Sequence
  Synthetic oligonucleotide
gcgcccagctcagagtgctgcagccgc

SEQ ID NO: 5182 - DNA, 27 bp, Artificial Sequence
  Synthetic oligonucleotide
cgcccagctcagagtgctgcagccgct

SEQ ID NO: 5183 - DNA, 27 bp, Artificial Sequence
  Synthetic oligonucleotide
cccagctcagagtgctgcagccgctgc

SEQ ID NO: 5184 - DNA, 27 bp, Artificial Sequence
  Synthetic oligonucleotide
ccagctcagagtgctgcagccgctgcc

SEQ ID NO: 5185 - DNA, 27 bp, Artificial Sequence
  Synthetic oligonucleotide
cagctcagagtgctgcagccgctgccg

SEQ ID NO: 5186 - DNA, 27 bp, Artificial Sequence
  Synthetic oligonucleotide
agctcagagtgctgcagccgctgccgc

SEQ ID NO: 5187 - DNA, 27 bp, Artificial Sequence
  Synthetic oligonucleotide
agccgctgccgccgattccggatctca

SEQ ID NO: 5188 - DNA, 27 bp, Artificial Sequence
  Synthetic oligonucleotide
gccgctgccgccgattccggatctcat

SEQ ID NO: 5189 - DNA, 27 bp, Artificial Sequence
  Synthetic oligonucleotide
ccgctgccgccgattccggatctcatt

SEQ ID NO: 5190 - DNA, 27 bp, Artificial Sequence
  Synthetic oligonucleotide
cgctgccgccgattccggatctcattg

SEQ ID NO: 5191 - DNA, 27 bp, Artificial Sequence
  Synthetic oligonucleotide
gctgccgccgattccggatctcattgc

SEQ ID NO: 5192 - DNA, 27 bp, Artificial Sequence
  Synthetic oligonucleotide
ctgccgccgattccggatctcattgcc

SEQ ID NO: 5193 - DNA, 27 bp, Artificial Sequence
  Synthetic oligonucleotide
tgccgccgattccggatctcattgcca

SEQ ID NO: 5194 - DNA, 27 bp, Artificial Sequence
  Synthetic oligonucleotide
gccgccgattccggatctcattgccac

SEQ ID NO: 5195 - DNA, 27 bp, Artificial Sequence
  Synthetic oligonucleotide
ccgccgattccggatctcattgccacg

SEQ ID NO: 5196 - DNA, 27 bp, Artificial Sequence
  Synthetic oligonucleotide
cgccgattccggatctcattgccacgc

SEQ ID NO: 5197 - DNA, 27 bp, Artificial Sequence
  Synthetic oligonucleotide
gccgattccggatctcattgccacgcg

SEQ ID NO: 5198 - DNA, 27 bp, Artificial Sequence
  Synthetic oligonucleotide
ccgattccggatctcattgccacgcgc

SEQ ID NO: 5199 - DNA, 27 bp, Artificial Sequence
  Synthetic oligonucleotide
cgattccggatctcattgccacgcgcc

SEQ ID NO: 5200 - DNA, 27 bp, Artificial Sequence
  Synthetic oligonucleotide
gattccggatctcattgccacgcgccc

SEQ ID NO: 5201 - DNA, 27 bp, Artificial Sequence
  Synthetic oligonucleotide
attccggatctcattgccacgcgcccc

SEQ ID NO: 5202 - DNA, 27 bp, Artificial Sequence
  Synthetic oligonucleotide
ttccggatctcattgccacgcgccccc

SEQ ID NO: 5203 - DNA, 27 bp, Artificial Sequence
  Synthetic oligonucleotide
tccggatctcattgccacgcgcccccg

SEQ ID NO: 5204 - DNA, 27 bp, Artificial Sequence
  Synthetic oligonucleotide
ccggatctcattgccacgcgcccccga

SEQ ID NO: 5205 - DNA, 27 bp, Artificial Sequence
  Synthetic oligonucleotide
cggatctcattgccacgcgcccccgac

SEQ ID NO: 5206 - DNA, 27 bp, Artificial Sequence
  Synthetic oligonucleotide
ggatctcattgccacgcgcccccgacg

SEQ ID NO: 5207 - DNA, 27 bp, Artificial Sequence
  Synthetic oligonucleotide
gatctcattgccacgcgcccccgacga

SEQ ID NO: 5208 - DNA, 27 bp, Artificial Sequence
  Synthetic oligonucleotide
atctcattgccacgcgcccccgacgac

SEQ ID NO: 5209 - DNA, 27 bp, Artificial Sequence
  Synthetic oligonucleotide
tctcattgccacgcgcccccgacgacc

SEQ ID NO: 5210 - DNA, 27 bp, Artificial Sequence
  Synthetic oligonucleotide
ctcattgccacgcgcccccgacgaccg

SEQ ID NO: 5211 - DNA, 27 bp, Artificial Sequence
  Synthetic oligonucleotide
tcattgccacgcgcccccgacgaccgc

SEQ ID NO: 5212 - DNA, 27 bp, Artificial Sequence
  Synthetic oligonucleotide
gcccccgacgaccgcccgacgtgcatt

SEQ ID NO: 5213 - DNA, 27 bp, Artificial Sequence
  Synthetic oligonucleotide
cccccgacgaccgcccgacgtgcattc

SEQ ID NO: 5214 - DNA, 27 bp, Artificial Sequence
  Synthetic oligonucleotide
ccccgacgaccgcccgacgtgcattcc

SEQ ID NO: 5215 - DNA, 27 bp, Artificial Sequence
  Synthetic oligonucleotide
cccgacgaccgcccgacgtgcattccc

SEQ ID NO: 5216 - DNA, 27 bp, Artificial Sequence
  Synthetic oligonucleotide
ccgacgaccgcccgacgtgcattcccg

SEQ ID NO: 5217 - DNA, 27 bp, Artificial Sequence
  Synthetic oligonucleotide
cgacgaccgcccgacgtgcattcccga

SEQ ID NO: 5218 - DNA, 27 bp, Artificial Sequence
  Synthetic oligonucleotide
gacgaccgcccgacgtgcattcccgat

SEQ ID NO: 5219 - DNA, 27 bp, Artificial Sequence
  Synthetic oligonucleotide
acgaccgcccgacgtgcattcccgatt

SEQ ID NO: 5220 - DNA, 27 bp, Artificial Sequence
  Synthetic oligonucleotide
cgaccgcccgacgtgcattcccgattc

SEQ ID NO: 5221 - DNA, 27 bp, Artificial Sequence
  Synthetic oligonucleotide
gaccgcccgacgtgcattcccgattcc

SEQ ID NO: 5222 - DNA, 27 bp, Artificial Sequence
  Synthetic oligonucleotide
accgcccgacgtgcattcccgattcct

SEQ ID NO: 5223 - DNA, 27 bp, Artificial Sequence
  Synthetic oligonucleotide
ccgcccgacgtgcattcccgattcctt

SEQ ID NO: 5224 - DNA, 27 bp, Artificial Sequence
  Synthetic oligonucleotide
cgcccgacgtgcattcccgattccttt

SEQ ID NO: 5225 - DNA, 27 bp, Artificial Sequence
  Synthetic oligonucleotide
gcccgacgtgcattcccgattcctttt

SEQ ID NO: 5226 - DNA, 27 bp, Artificial Sequence
  Synthetic oligonucleotide
cccgacgtgcattcccgattccttttg

SEQ ID NO: 5227 - DNA, 27 bp, Artificial Sequence
  Synthetic oligonucleotide
ccgacgtgcattcccgattccttttgg

SEQ ID NO: 5228 - DNA, 27 bp, Artificial Sequence
  Synthetic oligonucleotide
cgacgtgcattcccgattccttttggt

SEQ ID NO: 5229 - DNA, 27 bp, Artificial Sequence
  Synthetic oligonucleotide
gacgtgcattcccgattccttttggtt

SEQ ID NO: 5230 - DNA, 27 bp, Artificial Sequence
  Synthetic oligonucleotide
acgtgcattcccgattccttttggttc

SEQ ID NO: 5231 - DNA, 27 bp, Artificial Sequence
  Synthetic oligonucleotide
cgtgcattcccgattccttttggttcc

SEQ ID NO: 5232 - DNA, 27 bp, Artificial Sequence
  Synthetic oligonucleotide
gtgcattcccgattccttttggttcca

SEQ ID NO: 5233 - DNA, 27 bp, Artificial Sequence
  Synthetic oligonucleotide
tgcattcccgattccttttggttccaa

SEQ ID NO: 5234 - DNA, 27 bp, Artificial Sequence
  Synthetic oligonucleotide
gcattcccgattccttttggttccaag

SEQ ID NO: 5235 - DNA, 27 bp, Artificial Sequence
  Synthetic oligonucleotide
cattcccgattccttttggttccaagt

SEQ ID NO: 5236 - DNA, 27 bp, Artificial Sequence
  Synthetic oligonucleotide
attcccgattccttttggttccaagtc

SEQ ID NO: 5237 - DNA, 27 bp, Artificial Sequence
  Synthetic oligonucleotide
ttcccgattccttttggttccaagtcc

SEQ ID NO: 5238 - DNA, 27 bp, Artificial Sequence
  Synthetic oligonucleotide
tcccgattccttttggttccaagtcca

SEQ ID NO: 5239 - DNA, 27 bp, Artificial Sequence
  Synthetic oligonucleotide
cccgattccttttggttccaagtccaa

SEQ ID NO: 5240 - DNA, 27 bp, Artificial Sequence
  Synthetic oligonucleotide
ccgattccttttggttccaagtccaat

SEQ ID NO: 5241 - DNA, 27 bp, Artificial Sequence
  Synthetic oligonucleotide
cgattccttttggttccaagtccaata

SEQ ID NO: 5242 - DNA, 27 bp, Artificial Sequence
  Synthetic oligonucleotide
gattccttttggttccaagtccaatat

SEQ ID NO: 5243 - DNA, 27 bp, Artificial Sequence
  Synthetic oligonucleotide
attccttttggttccaagtccaatatg

SEQ ID NO: 5244 - DNA, 27 bp, Artificial Sequence
  Synthetic oligonucleotide
ttccttttggttccaagtccaatatgg

SEQ ID NO: 5245 - DNA, 27 bp, Artificial Sequence
  Synthetic oligonucleotide
tccttttggttccaagtccaatatggc

SEQ ID NO: 5246 - DNA, 27 bp, Artificial Sequence
  Synthetic oligonucleotide
ccttttggttccaagtccaatatggca

SEQ ID NO: 5247 - DNA, 27 bp, Artificial Sequence
  Synthetic oligonucleotide
cttttggttccaagtccaatatggcaa

SEQ ID NO: 5248 - DNA, 27 bp, Artificial Sequence
  Synthetic oligonucleotide
ttttggttccaagtccaatatggcaac

SEQ ID NO: 5249 - DNA, 27 bp, Artificial Sequence
  Synthetic oligonucleotide
tttggttccaagtccaatatggcaact

SEQ ID NO: 5250 - DNA, 27 bp, Artificial Sequence
  Synthetic oligonucleotide
ttggttccaagtccaatatggcaactc

SEQ ID NO: 5251 - DNA, 27 bp, Artificial Sequence
  Synthetic oligonucleotide
tggttccaagtccaatatggcaactct

SEQ ID NO: 5252 - DNA, 27 bp, Artificial Sequence
  Synthetic oligonucleotide
ggttccaagtccaatatggcaactcta

SEQ ID NO: 5253 - DNA, 27 bp, Artificial Sequence
  Synthetic oligonucleotide
gttccaagtccaatatggcaactctaa

SEQ ID NO: 5254 - DNA, 27 bp, Artificial Sequence
  Synthetic oligonucleotide
ttccaagtccaatatggcaactctaaa

SEQ ID NO: 5255 - DNA, 27 bp, Artificial Sequence
  Synthetic oligonucleotide
tccaagtccaatatggcaactctaaag

SEQ ID NO: 5256 - DNA, 27 bp, Artificial Sequence
  Synthetic oligonucleotide
ccaagtccaatatggcaactctaaagg

SEQ ID NO: 5257 - DNA, 27 bp, Artificial Sequence
  Synthetic oligonucleotide
caagtccaatatggcaactctaaagga

SEQ ID NO: 5258 - DNA, 27 bp, Artificial Sequence
  Synthetic oligonucleotide
aagtccaatatggcaactctaaaggat

SEQ ID NO: 5259 - DNA, 27 bp, Artificial Sequence
  Synthetic oligonucleotide
agtccaatatggcaactctaaaggatc

SEQ ID NO: 5260 - DNA, 27 bp, Artificial Sequence
  Synthetic oligonucleotide
gtccaatatggcaactctaaaggatca

SEQ ID NO: 5261 - DNA, 27 bp, Artificial Sequence
  Synthetic oligonucleotide
tccaatatggcaactctaaaggatcag

SEQ ID NO: 5262 - DNA, 27 bp, Artificial Sequence
  Synthetic oligonucleotide
ccaatatggcaactctaaaggatcagc

SEQ ID NO: 5263 - DNA, 27 bp, Artificial Sequence
  Synthetic oligonucleotide
caatatggcaactctaaaggatcagct

SEQ ID NO: 5264 - DNA, 27 bp, Artificial Sequence
  Synthetic oligonucleotide
aatatggcaactctaaaggatcagctg

SEQ ID NO: 5265 - DNA, 27 bp, Artificial Sequence
  Synthetic oligonucleotide
atatggcaactctaaaggatcagctga

SEQ ID NO: 5266 - DNA, 27 bp, Artificial Sequence
  Synthetic oligonucleotide
tatggcaactctaaaggatcagctgat

SEQ ID NO: 5267 - DNA, 27 bp, Artificial Sequence
  Synthetic oligonucleotide
atggcaactctaaaggatcagctgatt

SEQ ID NO: 5268 - DNA, 27 bp, Artificial Sequence
  Synthetic oligonucleotide
tggcaactctaaaggatcagctgattt

SEQ ID NO: 5269 - DNA, 27 bp, Artificial Sequence
  Synthetic oligonucleotide
ggcaactctaaaggatcagctgattta

SEQ ID NO: 5270 - DNA, 27 bp, Artificial Sequence
  Synthetic oligonucleotide
gcaactctaaaggatcagctgatttat

SEQ ID NO: 5271 - DNA, 27 bp, Artificial Sequence
  Synthetic oligonucleotide
caactctaaaggatcagctgatttata

SEQ ID NO: 5272 - DNA, 27 bp, Artificial Sequence
  Synthetic oligonucleotide
aactctaaaggatcagctgatttataa

SEQ ID NO: 5273 - DNA, 27 bp, Artificial Sequence
  Synthetic oligonucleotide
actctaaaggatcagctgatttataat

SEQ ID NO: 5274 - DNA, 27 bp, Artificial Sequence
  Synthetic oligonucleotide
ctctaaaggatcagctgatttataatc

SEQ ID NO: 5275 - DNA, 27 bp, Artificial Sequence
  Synthetic oligonucleotide
tctaaaggatcagctgatttataatct

SEQ ID NO: 5276 - DNA, 27 bp, Artificial Sequence
  Synthetic oligonucleotide
ctaaaggatcagctgatttataatctt

SEQ ID NO: 5277 - DNA, 27 bp, Artificial Sequence
  Synthetic oligonucleotide
taaaggatcagctgatttataatcttc

SEQ ID NO: 5278 - DNA, 27 bp, Artificial Sequence
  Synthetic oligonucleotide
aaaggatcagctgatttataatcttct

SEQ ID NO: 5279 - DNA, 27 bp, Artificial Sequence
  Synthetic oligonucleotide
aaggatcagctgatttataatcttcta

SEQ ID NO: 5280 - DNA, 27 bp, Artificial Sequence
  Synthetic oligonucleotide
aggatcagctgatttataatcttctaa

SEQ ID NO: 5281 - DNA, 27 bp, Artificial Sequence
  Synthetic oligonucleotide
ggatcagctgatttataatcttctaaa

SEQ ID NO: 5282 - DNA, 27 bp, Artificial Sequence
  Synthetic oligonucleotide
gatcagctgatttataatcttctaaag

SEQ ID NO: 5283 - DNA, 27 bp, Artificial Sequence
  Synthetic oligonucleotide
atcagctgatttataatcttctaaagg

SEQ ID NO: 5284 - DNA, 27 bp, Artificial Sequence
  Synthetic oligonucleotide
tcagctgatttataatcttctaaagga

SEQ ID NO: 5285 - DNA, 27 bp, Artificial Sequence
  Synthetic oligonucleotide
cagctgatttataatcttctaaaggaa

SEQ ID NO: 5286 - DNA, 27 bp, Artificial Sequence
  Synthetic oligonucleotide
agctgatttataatcttctaaaggaag

SEQ ID NO: 5287 - DNA, 27 bp, Artificial Sequence
  Synthetic oligonucleotide
gctgatttataatcttctaaaggaaga

SEQ ID NO: 5288 - DNA, 27 bp, Artificial Sequence
  Synthetic oligonucleotide
ctgatttataatcttctaaaggaagaa

SEQ ID NO: 5289 - DNA, 27 bp, Artificial Sequence
  Synthetic oligonucleotide
tgatttataatcttctaaaggaagaac

SEQ ID NO: 5290 - DNA, 27 bp, Artificial Sequence
  Synthetic oligonucleotide
gatttataatcttctaaaggaagaaca

SEQ ID NO: 5291 - DNA, 27 bp, Artificial Sequence
  Synthetic oligonucleotide
atttataatcttctaaaggaagaacag

SEQ ID NO: 5292 - DNA, 27 bp, Artificial Sequence
  Synthetic oligonucleotide
tttataatcttctaaaggaagaacaga

SEQ ID NO: 5293 - DNA, 27 bp, Artificial Sequence
  Synthetic oligonucleotide
ttataatcttctaaaggaagaacagac

SEQ ID NO: 5294 - DNA, 27 bp, Artificial Sequence
  Synthetic oligonucleotide
tataatcttctaaaggaagaacagacc

SEQ ID NO: 5295 - DNA, 27 bp, Artificial Sequence
  Synthetic oligonucleotide
ataatcttctaaaggaagaacagaccc

SEQ ID NO: 5296 - DNA, 27 bp, Artificial Sequence
  Synthetic oligonucleotide
taatcttctaaaggaagaacagacccc

SEQ ID NO: 5297 - DNA, 27 bp, Artificial Sequence
  Synthetic oligonucleotide
aatcttctaaaggaagaacagaccccc

SEQ ID NO: 5298 - DNA, 27 bp, Artificial Sequence
  Synthetic oligonucleotide
atcttctaaaggaagaacagacccccc

SEQ ID NO: 5299 - DNA, 27 bp, Artificial Sequence
  Synthetic oligonucleotide
tcttctaaaggaagaacagacccccca

SEQ ID NO: 5300 - DNA, 27 bp, Artificial Sequence
  Synthetic oligonucleotide
cttctaaaggaagaacagaccccccag

SEQ ID NO: 5301 - DNA, 27 bp, Artificial Sequence
  Synthetic oligonucleotide
ttctaaaggaagaacagaccccccaga

SEQ ID NO: 5302 - DNA, 27 bp, Artificial Sequence
  Synthetic oligonucleotide
tctaaaggaagaacagaccccccagaa

SEQ ID NO: 5303 - DNA, 27 bp, Artificial Sequence
  Synthetic oligonucleotide
ctaaaggaagaacagaccccccagaat

SEQ ID NO: 5304 - DNA, 27 bp, Artificial Sequence
  Synthetic oligonucleotide
taaaggaagaacagaccccccagaata

SEQ ID NO: 5305 - DNA, 27 bp, Artificial Sequence
  Synthetic oligonucleotide
aaaggaagaacagaccccccagaataa

SEQ ID NO: 5306 - DNA, 27 bp, Artificial Sequence
  Synthetic oligonucleotide
aaggaagaacagaccccccagaataag

SEQ ID NO: 5307 - DNA, 27 bp, Artificial Sequence
  Synthetic oligonucleotide
aggaagaacagaccccccagaataaga

SEQ ID NO: 5308 - DNA, 27 bp, Artificial Sequence
  Synthetic oligonucleotide
ggaagaacagaccccccagaataagat

SEQ ID NO: 5309 - DNA, 27 bp, Artificial Sequence
  Synthetic oligonucleotide
gaagaacagaccccccagaataagatt

SEQ ID NO: 5310 - DNA, 27 bp, Artificial Sequence
  Synthetic oligonucleotide
aagaacagaccccccagaataagatta

SEQ ID NO: 5311 - DNA, 27 bp, Artificial Sequence
  Synthetic oligonucleotide
agaacagaccccccagaataagattac

SEQ ID NO: 5312 - DNA, 27 bp, Artificial Sequence
  Synthetic oligonucleotide
gaacagaccccccagaataagattaca

SEQ ID NO: 5313 - DNA, 27 bp, Artificial Sequence
  Synthetic oligonucleotide
aacagaccccccagaataagattacag

SEQ ID NO: 5314 - DNA, 27 bp, Artificial Sequence
  Synthetic oligonucleotide
acagaccccccagaataagattacagt

SEQ ID NO: 5315 - DNA, 27 bp, Artificial Sequence
  Synthetic oligonucleotide
cagaccccccagaataagattacagtt

SEQ ID NO: 5316 - DNA, 27 bp, Artificial Sequence
  Synthetic oligonucleotide
agaccccccagaataagattacagttg

SEQ ID NO: 5317 - DNA, 27 bp, Artificial Sequence
  Synthetic oligonucleotide
gaccccccagaataagattacagttgt

SEQ ID NO: 5318 - DNA, 27 bp, Artificial Sequence
  Synthetic oligonucleotide
accccccagaataagattacagttgtt

SEQ ID NO: 5319 - DNA, 27 bp, Artificial Sequence
  Synthetic oligonucleotide
ccccccagaataagattacagttgttg

SEQ ID NO: 5320 - DNA, 27 bp, Artificial Sequence
  Synthetic oligonucleotide
cccccagaataagattacagttgttgg

SEQ ID NO: 5321 - DNA, 27 bp, Artificial Sequence
  Synthetic oligonucleotide
ccccagaataagattacagttgttggg

SEQ ID NO: 5322 - DNA, 27 bp, Artificial Sequence
  Synthetic oligonucleotide
cccagaataagattacagttgttgggg

SEQ ID NO: 5323 - DNA, 27 bp, Artificial Sequence
  Synthetic oligonucleotide
agaataagattacagttgttggggttg

SEQ ID NO: 5324 - DNA, 27 bp, Artificial Sequence
  Synthetic oligonucleotide
gaataagattacagttgttggggttgg

SEQ ID NO: 5325 - DNA, 27 bp, Artificial Sequence
  Synthetic oligonucleotide
aataagattacagttgttggggttggt

SEQ ID NO: 5326 - DNA, 27 bp, Artificial Sequence
  Synthetic oligonucleotide
acagttgttggggttggtgctgttggc

SEQ ID NO: 5327 - DNA, 27 bp, Artificial Sequence
  Synthetic oligonucleotide
gttgttggggttggtgctgttggcatg

SEQ ID NO: 5328 - DNA, 27 bp, Artificial Sequence
  Synthetic oligonucleotide
ttgttggggttggtgctgttggcatgg

SEQ ID NO: 5329 - DNA, 27 bp, Artificial Sequence
  Synthetic oligonucleotide
tgttggggttggtgctgttggcatggc

SEQ ID NO: 5330 - DNA, 27 bp, Artificial Sequence
  Synthetic oligonucleotide
gttggggttggtgctgttggcatggcc

SEQ ID NO: 5331 - DNA, 27 bp, Artificial Sequence
  Synthetic oligonucleotide
ttggggttggtgctgttggcatggcct

SEQ ID NO: 5332 - DNA, 27 bp, Artificial Sequence
  Synthetic oligonucleotide
tggggttggtgctgttggcatggcctg

SEQ ID NO: 5333 - DNA, 27 bp, Artificial Sequence
  Synthetic oligonucleotide
ggggttggtgctgttggcatggcctgt

SEQ ID NO: 5334 - DNA, 27 bp, Artificial Sequence
  Synthetic oligonucleotide
gggttggtgctgttggcatggcctgtg

SEQ ID NO: 5335 - DNA, 27 bp, Artificial Sequence
  Synthetic oligonucleotide
ggttggtgctgttggcatggcctgtgc

SEQ ID NO: 5336 - DNA, 27 bp, Artificial Sequence
  Synthetic oligonucleotide
gttggtgctgttggcatggcctgtgcc

SEQ ID NO: 5337 - DNA, 27 bp, Artificial Sequence
  Synthetic oligonucleotide
ttggtgctgttggcatggcctgtgcca

SEQ ID NO: 5338 - DNA, 27 bp, Artificial Sequence
  Synthetic oligonucleotide
tggtgctgttggcatggcctgtgccat

SEQ ID NO: 5339 - DNA, 27 bp, Artificial Sequence
  Synthetic oligonucleotide
ggtgctgttggcatggcctgtgccatc

SEQ ID NO: 5340 - DNA, 27 bp, Artificial Sequence
  Synthetic oligonucleotide
gtgctgttggcatggcctgtgccatca

SEQ ID NO: 5341 - DNA, 27 bp, Artificial Sequence
  Synthetic oligonucleotide
tgctgttggcatggcctgtgccatcag

SEQ ID NO: 5342 - DNA, 27 bp, Artificial Sequence
  Synthetic oligonucleotide
gctgttggcatggcctgtgccatcagt

SEQ ID NO: 5343 - DNA, 27 bp, Artificial Sequence
  Synthetic oligonucleotide
ctgttggcatggcctgtgccatcagta

SEQ ID NO: 5344 - DNA, 27 bp, Artificial Sequence
  Synthetic oligonucleotide
tgttggcatggcctgtgccatcagtat

SEQ ID NO: 5345 - DNA, 27 bp, Artificial Sequence
  Synthetic oligonucleotide
gttggcatggcctgtgccatcagtatc

SEQ ID NO: 5346 - DNA, 27 bp, Artificial Sequence
  Synthetic oligonucleotide
ttggcatggcctgtgccatcagtatct

SEQ ID NO: 5347 - DNA, 27 bp, Artificial Sequence
  Synthetic oligonucleotide
tggcatggcctgtgccatcagtatctt

SEQ ID NO: 5348 - DNA, 27 bp, Artificial Sequence
  Synthetic oligonucleotide
ggcatggcctgtgccatcagtatctta

SEQ ID NO: 5349 - DNA, 27 bp, Artificial Sequence
  Synthetic oligonucleotide
gcatggcctgtgccatcagtatcttaa

SEQ ID NO: 5350 - DNA, 27 bp, Artificial Sequence
  Synthetic oligonucleotide
catggcctgtgccatcagtatcttaat

SEQ ID NO: 5351 - DNA, 27 bp, Artificial Sequence
  Synthetic oligonucleotide
atggcctgtgccatcagtatcttaatg

SEQ ID NO: 5352 - DNA, 27 bp, Artificial Sequence
  Synthetic oligonucleotide
tggcctgtgccatcagtatcttaatga

SEQ ID NO: 5353 - DNA, 27 bp, Artificial Sequence
  Synthetic oligonucleotide
ccatcagtatcttaatgaaggacttgg

SEQ ID NO: 5354 - DNA, 27 bp, Artificial Sequence
  Synthetic oligonucleotide
catcagtatcttaatgaaggacttggc

SEQ ID NO: 5355 - DNA, 27 bp, Artificial Sequence
  Synthetic oligonucleotide
atcagtatcttaatgaaggacttggca

SEQ ID NO: 5356 - DNA, 27 bp, Artificial Sequence
  Synthetic oligonucleotide
tcagtatcttaatgaaggacttggcag

SEQ ID NO: 5357 - DNA, 27 bp, Artificial Sequence
  Synthetic oligonucleotide
cagtatcttaatgaaggacttggcaga

SEQ ID NO: 5358 - DNA, 27 bp, Artificial Sequence
  Synthetic oligonucleotide
agtatcttaatgaaggacttggcagat

SEQ ID NO: 5359 - DNA, 27 bp, Artificial Sequence
  Synthetic oligonucleotide
gtatcttaatgaaggacttggcagatg

SEQ ID NO: 5360 - DNA, 27 bp, Artificial Sequence
  Synthetic oligonucleotide
tatcttaatgaaggacttggcagatga

SEQ ID NO: 5361 - DNA, 27 bp, Artificial Sequence
  Synthetic oligonucleotide
atcttaatgaaggacttggcagatgaa

SEQ ID NO: 5362 - DNA, 27 bp, Artificial Sequence
  Synthetic oligonucleotide
tcttaatgaaggacttggcagatgaac

SEQ ID NO: 5363 - DNA, 27 bp, Artificial Sequence
  Synthetic oligonucleotide
cttaatgaaggacttggcagatgaact

SEQ ID NO: 5364 - DNA, 27 bp, Artificial Sequence
  Synthetic oligonucleotide
ttaatgaaggacttggcagatgaactt

SEQ ID NO: 5365 - DNA, 27 bp, Artificial Sequence
  Synthetic oligonucleotide
taatgaaggacttggcagatgaacttg

SEQ ID NO: 5366 - DNA, 27 bp, Artificial Sequence
  Synthetic oligonucleotide
aatgaaggacttggcagatgaacttgc

SEQ ID NO: 5367 - DNA, 27 bp, Artificial Sequence
  Synthetic oligonucleotide
atgaaggacttggcagatgaacttgct

SEQ ID NO: 5368 - DNA, 27 bp, Artificial Sequence
  Synthetic oligonucleotide
tgaaggacttggcagatgaacttgctc

SEQ ID NO: 5369 - DNA, 27 bp, Artificial Sequence
  Synthetic oligonucleotide
gaaggacttggcagatgaacttgctct

SEQ ID NO: 5370 - DNA, 27 bp, Artificial Sequence
  Synthetic oligonucleotide
aaggacttggcagatgaacttgctctt

SEQ ID NO: 5371 - DNA, 27 bp, Artificial Sequence
  Synthetic oligonucleotide
aggacttggcagatgaacttgctcttg

SEQ ID NO: 5372 - DNA, 27 bp, Artificial Sequence
  Synthetic oligonucleotide
ggacttggcagatgaacttgctcttgt

SEQ ID NO: 5373 - DNA, 27 bp, Artificial Sequence
  Synthetic oligonucleotide
gacttggcagatgaacttgctcttgtt

SEQ ID NO: 5374 - DNA, 27 bp, Artificial Sequence
  Synthetic oligonucleotide
acttggcagatgaacttgctcttgttg

SEQ ID NO: 5375 - DNA, 27 bp, Artificial Sequence
  Synthetic oligonucleotide
cttggcagatgaacttgctcttgttga

SEQ ID NO: 5376 - DNA, 27 bp, Artificial Sequence
  Synthetic oligonucleotide
ttggcagatgaacttgctcttgttgat

SEQ ID NO: 5377 - DNA, 27 bp, Artificial Sequence
  Synthetic oligonucleotide
tggcagatgaacttgctcttgttgatg

SEQ ID NO: 5378 - DNA, 27 bp, Artificial Sequence
  Synthetic oligonucleotide
ggcagatgaacttgctcttgttgatgt

SEQ ID NO: 5379 - DNA, 27 bp, Artificial Sequence
  Synthetic oligonucleotide
gcagatgaacttgctcttgttgatgtc

SEQ ID NO: 5380 - DNA, 27 bp, Artificial Sequence
  Synthetic oligonucleotide
cagatgaacttgctcttgttgatgtca

SEQ ID NO: 5381 - DNA, 27 bp, Artificial Sequence
  Synthetic oligonucleotide
agatgaacttgctcttgttgatgtcat

SEQ ID NO: 5382 - DNA, 27 bp, Artificial Sequence
  Synthetic oligonucleotide
gatgaacttgctcttgttgatgtcatc

SEQ ID NO: 5383 - DNA, 27 bp, Artificial Sequence
  Synthetic oligonucleotide
atgaacttgctcttgttgatgtcatcg

SEQ ID NO: 5384 - DNA, 27 bp, Artificial Sequence
  Synthetic oligonucleotide
tgaacttgctcttgttgatgtcatcga

SEQ ID NO: 5385 - DNA, 27 bp, Artificial Sequence
  Synthetic oligonucleotide
gaacttgctcttgttgatgtcatcgaa

SEQ ID NO: 5386 - DNA, 27 bp, Artificial Sequence
  Synthetic oligonucleotide
aacttgctcttgttgatgtcatcgaag

SEQ ID NO: 5387 - DNA, 27 bp, Artificial Sequence
  Synthetic oligonucleotide
acttgctcttgttgatgtcatcgaaga

SEQ ID NO: 5388 - DNA, 27 bp, Artificial Sequence
  Synthetic oligonucleotide
cttgctcttgttgatgtcatcgaagac

SEQ ID NO: 5389 - DNA, 27 bp, Artificial Sequence
  Synthetic oligonucleotide
ttgctcttgttgatgtcatcgaagaca

SEQ ID NO: 5390 - DNA, 27 bp, Artificial Sequence
  Synthetic oligonucleotide
tgctcttgttgatgtcatcgaagacaa

SEQ ID NO: 5391 - DNA, 27 bp, Artificial Sequence
  Synthetic oligonucleotide
gctcttgttgatgtcatcgaagacaaa

SEQ ID NO: 5392 - DNA, 27 bp, Artificial Sequence
  Synthetic oligonucleotide
ctcttgttgatgtcatcgaagacaaat

SEQ ID NO: 5393 - DNA, 27 bp, Artificial Sequence
  Synthetic oligonucleotide
tcttgttgatgtcatcgaagacaaatt

SEQ ID NO: 5394 - DNA, 27 bp, Artificial Sequence
  Synthetic oligonucleotide
cttgttgatgtcatcgaagacaaattg

SEQ ID NO: 5395 - DNA, 27 bp, Artificial Sequence
  Synthetic oligonucleotide
ttgttgatgtcatcgaagacaaattga

SEQ ID NO: 5396 - DNA, 27 bp, Artificial Sequence
  Synthetic oligonucleotide
tgttgatgtcatcgaagacaaattgaa

SEQ ID NO: 5397 - DNA, 27 bp, Artificial Sequence
  Synthetic oligonucleotide
gttgatgtcatcgaagacaaattgaag

SEQ ID NO: 5398 - DNA, 27 bp, Artificial Sequence
  Synthetic oligonucleotide
ttgatgtcatcgaagacaaattgaagg

SEQ ID NO: 5399 - DNA, 27 bp, Artificial Sequence
  Synthetic oligonucleotide
tgatgtcatcgaagacaaattgaaggg

SEQ ID NO: 5400 - DNA, 27 bp, Artificial Sequence
  Synthetic oligonucleotide
gatgtcatcgaagacaaattgaaggga

SEQ ID NO: 5401 - DNA, 27 bp, Artificial Sequence
  Synthetic oligonucleotide
atgtcatcgaagacaaattgaagggag

SEQ ID NO: 5402 - DNA, 27 bp, Artificial Sequence
  Synthetic oligonucleotide
tgtcatcgaagacaaattgaagggaga

SEQ ID NO: 5403 - DNA, 27 bp, Artificial Sequence
  Synthetic oligonucleotide
gtcatcgaagacaaattgaagggagag

SEQ ID NO: 5404 - DNA, 27 bp, Artificial Sequence
  Synthetic oligonucleotide
tcatcgaagacaaattgaagggagaga

SEQ ID NO: 5405 - DNA, 27 bp, Artificial Sequence
  Synthetic oligonucleotide
catcgaagacaaattgaagggagagat

SEQ ID NO: 5406 - DNA, 27 bp, Artificial Sequence
  Synthetic oligonucleotide
atcgaagacaaattgaagggagagatg

SEQ ID NO: 5407 - DNA, 27 bp, Artificial Sequence
  Synthetic oligonucleotide
tcgaagacaaattgaagggagagatga

SEQ ID NO: 5408 - DNA, 27 bp, Artificial Sequence
  Synthetic oligonucleotide
cgaagacaaattgaagggagagatgat

SEQ ID NO: 5409 - DNA, 27 bp, Artificial Sequence
  Synthetic oligonucleotide
gaagacaaattgaagggagagatgatg

SEQ ID NO: 5410 - DNA, 27 bp, Artificial Sequence
  Synthetic oligonucleotide
aagacaaattgaagggagagatgatgg

SEQ ID NO: 5411 - DNA, 27 bp, Artificial Sequence
  Synthetic oligonucleotide
agacaaattgaagggagagatgatgga

SEQ ID NO: 5412 - DNA, 27 bp, Artificial Sequence
  Synthetic oligonucleotide
gacaaattgaagggagagatgatggat

SEQ ID NO: 5413 - DNA, 27 bp, Artificial Sequence
  Synthetic oligonucleotide
acaaattgaagggagagatgatggatc

SEQ ID NO: 5414 - DNA, 27 bp, Artificial Sequence
  Synthetic oligonucleotide
caaattgaagggagagatgatggatct

SEQ ID NO: 5415 - DNA, 27 bp, Artificial Sequence
  Synthetic oligonucleotide
aaattgaagggagagatgatggatctc

SEQ ID NO: 5416 - DNA, 27 bp, Artificial Sequence
  Synthetic oligonucleotide
aattgaagggagagatgatggatctcc

SEQ ID NO: 5417 - DNA, 27 bp, Artificial Sequence
  Synthetic oligonucleotide
attgaagggagagatgatggatctcca

SEQ ID NO: 5418 - DNA, 27 bp, Artificial Sequence
  Synthetic oligonucleotide
ttgaagggagagatgatggatctccaa

SEQ ID NO: 5419 - DNA, 27 bp, Artificial Sequence
  Synthetic oligonucleotide
tgaagggagagatgatggatctccaac

SEQ ID NO: 5420 - DNA, 27 bp, Artificial Sequence
  Synthetic oligonucleotide
gaagggagagatgatggatctccaaca

SEQ ID NO: 5421 - DNA, 27 bp, Artificial Sequence
  Synthetic oligonucleotide
aagggagagatgatggatctccaacat

SEQ ID NO: 5422 - DNA, 27 bp, Artificial Sequence
  Synthetic oligonucleotide
agggagagatgatggatctccaacatg

SEQ ID NO: 5423 - DNA, 27 bp, Artificial Sequence
  Synthetic oligonucleotide
gggagagatgatggatctccaacatgg

SEQ ID NO: 5424 - DNA, 27 bp, Artificial Sequence
  Synthetic oligonucleotide
ggagagatgatggatctccaacatggc

SEQ ID NO: 5425 - DNA, 27 bp, Artificial Sequence
  Synthetic oligonucleotide
gagagatgatggatctccaacatggca

SEQ ID NO: 5426 - DNA, 27 bp, Artificial Sequence
  Synthetic oligonucleotide
agagatgatggatctccaacatggcag

SEQ ID NO: 5427 - DNA, 27 bp, Artificial Sequence
  Synthetic oligonucleotide
gagatgatggatctccaacatggcagc

SEQ ID NO: 5428 - DNA, 27 bp, Artificial Sequence
  Synthetic oligonucleotide
agatgatggatctccaacatggcagcc

SEQ ID NO: 5429 - DNA, 27 bp, Artificial Sequence
  Synthetic oligonucleotide
gatgatggatctccaacatggcagcct

SEQ ID NO: 5430 - DNA, 27 bp, Artificial Sequence
  Synthetic oligonucleotide
atgatggatctccaacatggcagcctt

SEQ ID NO: 5431 - DNA, 27 bp, Artificial Sequence
  Synthetic oligonucleotide
tgatggatctccaacatggcagccttt

SEQ ID NO: 5432 - DNA, 27 bp, Artificial Sequence
  Synthetic oligonucleotide
gatggatctccaacatggcagcctttt

SEQ ID NO: 5433 - DNA, 27 bp, Artificial Sequence
  Synthetic oligonucleotide
atggatctccaacatggcagccttttc

SEQ ID NO: 5434 - DNA, 27 bp, Artificial Sequence
  Synthetic oligonucleotide
tggatctccaacatggcagccttttcc

SEQ ID NO: 5435 - DNA, 27 bp, Artificial Sequence
  Synthetic oligonucleotide
ggatctccaacatggcagccttttcct

SEQ ID NO: 5436 - DNA, 27 bp, Artificial Sequence
  Synthetic oligonucleotide
gatctccaacatggcagccttttcctt

SEQ ID NO: 5437 - DNA, 27 bp, Artificial Sequence
  Synthetic oligonucleotide
atctccaacatggcagccttttcctta

SEQ ID NO: 5438 - DNA, 27 bp, Artificial Sequence
  Synthetic oligonucleotide
tctccaacatggcagccttttccttag

SEQ ID NO: 5439 - DNA, 27 bp, Artificial Sequence
  Synthetic oligonucleotide
ctccaacatggcagccttttccttaga

SEQ ID NO: 5440 - DNA, 27 bp, Artificial Sequence
  Synthetic oligonucleotide
tccaacatggcagccttttccttagaa

SEQ ID NO: 5441 - DNA, 27 bp, Artificial Sequence
  Synthetic oligonucleotide
ccaacatggcagccttttccttagaac

SEQ ID NO: 5442 - DNA, 27 bp, Artificial Sequence
  Synthetic oligonucleotide
caacatggcagccttttccttagaaca

SEQ ID NO: 5443 - DNA, 27 bp, Artificial Sequence
  Synthetic oligonucleotide
aacatggcagccttttccttagaacac

SEQ ID NO: 5444 - DNA, 27 bp, Artificial Sequence
  Synthetic oligonucleotide
acatggcagccttttccttagaacacc

SEQ ID NO: 5445 - DNA, 27 bp, Artificial Sequence
  Synthetic oligonucleotide
catggcagccttttccttagaacacca

SEQ ID NO: 5446 - DNA, 27 bp, Artificial Sequence
  Synthetic oligonucleotide
atggcagccttttccttagaacaccaa

SEQ ID NO: 5447 - DNA, 27 bp, Artificial Sequence
  Synthetic oligonucleotide
tggcagccttttccttagaacaccaaa

SEQ ID NO: 5448 - DNA, 27 bp, Artificial Sequence
  Synthetic oligonucleotide
ggcagccttttccttagaacaccaaag

SEQ ID NO: 5449 - DNA, 27 bp, Artificial Sequence
  Synthetic oligonucleotide
gcagccttttccttagaacaccaaaga

SEQ ID NO: 5450 - DNA, 27 bp, Artificial Sequence
  Synthetic oligonucleotide
cagccttttccttagaacaccaaagat

SEQ ID NO: 5451 - DNA, 27 bp, Artificial Sequence
  Synthetic oligonucleotide
agccttttccttagaacaccaaagatt

SEQ ID NO: 5452 - DNA, 27 bp, Artificial Sequence
  Synthetic oligonucleotide
gccttttccttagaacaccaaagattg

SEQ ID NO: 5453 - DNA, 27 bp, Artificial Sequence
  Synthetic oligonucleotide
ccttttccttagaacaccaaagattgt

SEQ ID NO: 5454 - DNA, 27 bp, Artificial Sequence
  Synthetic oligonucleotide
cttttccttagaacaccaaagattgtc

SEQ ID NO: 5455 - DNA, 27 bp, Artificial Sequence
  Synthetic oligonucleotide
ttttccttagaacaccaaagattgtct

SEQ ID NO: 5456 - DNA, 27 bp, Artificial Sequence
  Synthetic oligonucleotide
tttccttagaacaccaaagattgtctc

SEQ ID NO: 5457 - DNA, 27 bp, Artificial Sequence
  Synthetic oligonucleotide
ttccttagaacaccaaagattgtctct

SEQ ID NO: 5458 - DNA, 27 bp, Artificial Sequence
  Synthetic oligonucleotide
tccttagaacaccaaagattgtctctg

SEQ ID NO: 5459 - DNA, 27 bp, Artificial Sequence
  Synthetic oligonucleotide
ccttagaacaccaaagattgtctctgg

SEQ ID NO: 5460 - DNA, 27 bp, Artificial Sequence
  Synthetic oligonucleotide
cttagaacaccaaagattgtctctggc

SEQ ID NO: 5461 - DNA, 27 bp, Artificial Sequence
  Synthetic oligonucleotide
ttagaacaccaaagattgtctctggca

SEQ ID NO: 5462 - DNA, 27 bp, Artificial Sequence
  Synthetic oligonucleotide
tagaacaccaaagattgtctctggcaa

SEQ ID NO: 5463 - DNA, 27 bp, Artificial Sequence
  Synthetic oligonucleotide
agaacaccaaagattgtctctggcaaa

SEQ ID NO: 5464 - DNA, 27 bp, Artificial Sequence
  Synthetic oligonucleotide
gaacaccaaagattgtctctggcaaag

SEQ ID NO: 5465 - DNA, 27 bp, Artificial Sequence
  Synthetic oligonucleotide
aacaccaaagattgtctctggcaaaga

SEQ ID NO: 5466 - DNA, 27 bp, Artificial Sequence
  Synthetic oligonucleotide
acaccaaagattgtctctggcaaagac

SEQ ID NO: 5467 - DNA, 27 bp, Artificial Sequence
  Synthetic oligonucleotide
caccaaagattgtctctggcaaagact

SEQ ID NO: 5468 - DNA, 27 bp, Artificial Sequence
  Synthetic oligonucleotide
accaaagattgtctctggcaaagacta

SEQ ID NO: 5469 - DNA, 27 bp, Artificial Sequence
  Synthetic oligonucleotide
ccaaagattgtctctggcaaagactat

SEQ ID NO: 5470 - DNA, 27 bp, Artificial Sequence
  Synthetic oligonucleotide
caaagattgtctctggcaaagactata

SEQ ID NO: 5471 - DNA, 27 bp, Artificial Sequence
  Synthetic oligonucleotide
aaagattgtctctggcaaagactataa

SEQ ID NO: 5472 - DNA, 27 bp, Artificial Sequence
  Synthetic oligonucleotide
aagattgtctctggcaaagactataat

SEQ ID NO: 5473 - DNA, 27 bp, Artificial Sequence
  Synthetic oligonucleotide
agattgtctctggcaaagactataatg

SEQ ID NO: 5474 - DNA, 27 bp, Artificial Sequence
  Synthetic oligonucleotide
gattgtctctggcaaagactataatgt

SEQ ID NO: 5475 - DNA, 27 bp, Artificial Sequence
  Synthetic oligonucleotide
attgtctctggcaaagactataatgta

SEQ ID NO: 5476 - DNA, 27 bp, Artificial Sequence
  Synthetic oligonucleotide
ttgtctctggcaaagactataatgtaa

SEQ ID NO: 5477 - DNA, 27 bp, Artificial Sequence
  Synthetic oligonucleotide
tgtctctggcaaagactataatgtaac

SEQ ID NO: 5478 - DNA, 27 bp, Artificial Sequence
  Synthetic oligonucleotide
gtctctggcaaagactataatgtaact

SEQ ID NO: 5479 - DNA, 27 bp, Artificial Sequence
  Synthetic oligonucleotide
tctctggcaaagactataatgtaactg

SEQ ID NO: 5480 - DNA, 27 bp, Artificial Sequence
  Synthetic oligonucleotide
ctctggcaaagactataatgtaactgc

SEQ ID NO: 5481 - DNA, 27 bp, Artificial Sequence
  Synthetic oligonucleotide
tctggcaaagactataatgtaactgca

SEQ ID NO: 5482 - DNA, 27 bp, Artificial Sequence
  Synthetic oligonucleotide
ctggcaaagactataatgtaactgcaa

SEQ ID NO: 5483 - DNA, 27 bp, Artificial Sequence
  Synthetic oligonucleotide
tggcaaagactataatgtaactgcaaa

SEQ ID NO: 5484 - DNA, 27 bp, Artificial Sequence
  Synthetic oligonucleotide
ggcaaagactataatgtaactgcaaac

SEQ ID NO: 5485 - DNA, 27 bp, Artificial Sequence
  Synthetic oligonucleotide
gcaaagactataatgtaactgcaaact

SEQ ID NO: 5486 - DNA, 27 bp, Artificial Sequence
  Synthetic oligonucleotide
caaagactataatgtaactgcaaactc

SEQ ID NO: 5487 - DNA, 27 bp, Artificial Sequence
  Synthetic oligonucleotide
aaagactataatgtaactgcaaactcc

SEQ ID NO: 5488 - DNA, 27 bp, Artificial Sequence
  Synthetic oligonucleotide
aagactataatgtaactgcaaactcca

SEQ ID NO: 5489 - DNA, 27 bp, Artificial Sequence
  Synthetic oligonucleotide
agactataatgtaactgcaaactccaa

SEQ ID NO: 5490 - DNA, 27 bp, Artificial Sequence
  Synthetic oligonucleotide
gactataatgtaactgcaaactccaag

SEQ ID NO: 5491 - DNA, 27 bp, Artificial Sequence
  Synthetic oligonucleotide
actataatgtaactgcaaactccaagc

SEQ ID NO: 5492 - DNA, 27 bp, Artificial Sequence
  Synthetic oligonucleotide
ctataatgtaactgcaaactccaagct

SEQ ID NO: 5493 - DNA, 27 bp, Artificial Sequence
  Synthetic oligonucleotide
tataatgtaactgcaaactccaagctg

SEQ ID NO: 5494 - DNA, 27 bp, Artificial Sequence
  Synthetic oligonucleotide
ataatgtaactgcaaactccaagctgg

SEQ ID NO: 5495 - DNA, 27 bp, Artificial Sequence
  Synthetic oligonucleotide
taatgtaactgcaaactccaagctggt

SEQ ID NO: 5496 - DNA, 27 bp, Artificial Sequence
  Synthetic oligonucleotide
aatgtaactgcaaactccaagctggtc

SEQ ID NO: 5497 - DNA, 27 bp, Artificial Sequence
  Synthetic oligonucleotide
atgtaactgcaaactccaagctggtca

SEQ ID NO: 5498 - DNA, 27 bp, Artificial Sequence
  Synthetic oligonucleotide
tgtaactgcaaactccaagctggtcat

SEQ ID NO: 5499 - DNA, 27 bp, Artificial Sequence
  Synthetic oligonucleotide
gtaactgcaaactccaagctggtcatt

SEQ ID NO: 5500 - DNA, 27 bp, Artificial Sequence
  Synthetic oligonucleotide
taactgcaaactccaagctggtcatta

SEQ ID NO: 5501 - DNA, 27 bp, Artificial Sequence
  Synthetic oligonucleotide
aactgcaaactccaagctggtcattat

SEQ ID NO: 5502 - DNA, 27 bp, Artificial Sequence
  Synthetic oligonucleotide
actgcaaactccaagctggtcattatc

SEQ ID NO: 5503 - DNA, 27 bp, Artificial Sequence
  Synthetic oligonucleotide
ctgcaaactccaagctggtcattatca

SEQ ID NO: 5504 - DNA, 27 bp, Artificial Sequence
  Synthetic oligonucleotide
tgcaaactccaagctggtcattatcac

SEQ ID NO: 5505 - DNA, 27 bp, Artificial Sequence
  Synthetic oligonucleotide
gcaaactccaagctggtcattatcacg

SEQ ID NO: 5506 - DNA, 27 bp, Artificial Sequence
  Synthetic oligonucleotide
caaactccaagctggtcattatcacgg

SEQ ID NO: 5507 - DNA, 27 bp, Artificial Sequence
  Synthetic oligonucleotide
aaactccaagctggtcattatcacggc

SEQ ID NO: 5508 - DNA, 27 bp, Artificial Sequence
  Synthetic oligonucleotide
aactccaagctggtcattatcacggct

SEQ ID NO: 5509 - DNA, 27 bp, Artificial Sequence
  Synthetic oligonucleotide
actccaagctggtcattatcacggctg

SEQ ID NO: 5510 - DNA, 27 bp, Artificial Sequence
  Synthetic oligonucleotide
ctccaagctggtcattatcacggctgg

SEQ ID NO: 5511 - DNA, 27 bp, Artificial Sequence
  Synthetic oligonucleotide
tccaagctggtcattatcacggctggg

SEQ ID NO: 5512 - DNA, 27 bp, Artificial Sequence
  Synthetic oligonucleotide
ccaagctggtcattatcacggctgggg

SEQ ID NO: 5513 - DNA, 27 bp, Artificial Sequence
  Synthetic oligonucleotide
caagctggtcattatcacggctggggc

SEQ ID NO: 5514 - DNA, 27 bp, Artificial Sequence
  Synthetic oligonucleotide
aagctggtcattatcacggctggggca

SEQ ID NO: 5515 - DNA, 27 bp, Artificial Sequence
  Synthetic oligonucleotide
agctggtcattatcacggctggggcac

SEQ ID NO: 5516 - DNA, 27 bp, Artificial Sequence
  Synthetic oligonucleotide
gctggtcattatcacggctggggcacg

SEQ ID NO: 5517 - DNA, 27 bp, Artificial Sequence
  Synthetic oligonucleotide
ctggtcattatcacggctggggcacgt

SEQ ID NO: 5518 - DNA, 27 bp, Artificial Sequence
  Synthetic oligonucleotide
tggtcattatcacggctggggcacgtc

SEQ ID NO: 5519 - DNA, 27 bp, Artificial Sequence
  Synthetic oligonucleotide
ggtcattatcacggctggggcacgtca

SEQ ID NO: 5520 - DNA, 27 bp, Artificial Sequence
  Synthetic oligonucleotide
gtcattatcacggctggggcacgtcag

SEQ ID NO: 5521 - DNA, 27 bp, Artificial Sequence
  Synthetic oligonucleotide
tcattatcacggctggggcacgtcagc

SEQ ID NO: 5522 - DNA, 27 bp, Artificial Sequence
  Synthetic oligonucleotide
cattatcacggctggggcacgtcagca

SEQ ID NO: 5523 - DNA, 27 bp, Artificial Sequence
  Synthetic oligonucleotide
attatcacggctggggcacgtcagcaa

SEQ ID NO: 5524 - DNA, 27 bp, Artificial Sequence
  Synthetic oligonucleotide
ttatcacggctggggcacgtcagcaag

SEQ ID NO: 5525 - DNA, 27 bp, Artificial Sequence
  Synthetic oligonucleotide
tatcacggctggggcacgtcagcaaga

SEQ ID NO: 5526 - DNA, 27 bp, Artificial Sequence
  Synthetic oligonucleotide
atcacggctggggcacgtcagcaagag

SEQ ID NO: 5527 - DNA, 27 bp, Artificial Sequence
  Synthetic oligonucleotide
tcacggctggggcacgtcagcaagagg

SEQ ID NO: 5528 - DNA, 27 bp, Artificial Sequence
  Synthetic oligonucleotide
cacggctggggcacgtcagcaagaggg

SEQ ID NO: 5529 - DNA, 27 bp, Artificial Sequence
  Synthetic oligonucleotide
acggctggggcacgtcagcaagaggga

SEQ ID NO: 5530 - DNA, 27 bp, Artificial Sequence
  Synthetic oligonucleotide
cggctggggcacgtcagcaagagggag

SEQ ID NO: 5531 - DNA, 27 bp, Artificial Sequence
  Synthetic oligonucleotide
ggctggggcacgtcagcaagagggaga

SEQ ID NO: 5532 - DNA, 27 bp, Artificial Sequence
  Synthetic oligonucleotide
gctggggcacgtcagcaagagggagaa

SEQ ID NO: 5533 - DNA, 27 bp, Artificial Sequence
  Synthetic oligonucleotide
ctggggcacgtcagcaagagggagaaa

SEQ ID NO: 5534 - DNA, 27 bp, Artificial Sequence
  Synthetic oligonucleotide
tggggcacgtcagcaagagggagaaag

SEQ ID NO: 5535 - DNA, 27 bp, Artificial Sequence
  Synthetic oligonucleotide
ggggcacgtcagcaagagggagaaagc

SEQ ID NO: 5536 - DNA, 27 bp, Artificial Sequence
  Synthetic oligonucleotide
gggcacgtcagcaagagggagaaagcc

SEQ ID NO: 5537 - DNA, 27 bp, Artificial Sequence
  Synthetic oligonucleotide
ggcacgtcagcaagagggagaaagccg

SEQ ID NO: 5538 - DNA, 27 bp, Artificial Sequence
  Synthetic oligonucleotide
gcacgtcagcaagagggagaaagccgt

SEQ ID NO: 5539 - DNA, 27 bp, Artificial Sequence
  Synthetic oligonucleotide
cacgtcagcaagagggagaaagccgtc

SEQ ID NO: 5540 - DNA, 27 bp, Artificial Sequence
  Synthetic oligonucleotide
acgtcagcaagagggagaaagccgtct

SEQ ID NO: 5541 - DNA, 27 bp, Artificial Sequence
  Synthetic oligonucleotide
cgtcagcaagagggagaaagccgtctt

SEQ ID NO: 5542 - DNA, 27 bp, Artificial Sequence
  Synthetic oligonucleotide
gtcagcaagagggagaaagccgtctta

SEQ ID NO: 5543 - DNA, 27 bp, Artificial Sequence
  Synthetic oligonucleotide
tcagcaagagggagaaagccgtcttaa

SEQ ID NO: 5544 - DNA, 27 bp, Artificial Sequence
  Synthetic oligonucleotide
cagcaagagggagaaagccgtcttaat

SEQ ID NO: 5545 - DNA, 27 bp, Artificial Sequence
  Synthetic oligonucleotide
agcaagagggagaaagccgtcttaatt

SEQ ID NO: 5546 - DNA, 27 bp, Artificial Sequence
  Synthetic oligonucleotide
gcaagagggagaaagccgtcttaattt

SEQ ID NO: 5547 - DNA, 27 bp, Artificial Sequence
  Synthetic oligonucleotide
caagagggagaaagccgtcttaatttg

SEQ ID NO: 5548 - DNA, 27 bp, Artificial Sequence
  Synthetic oligonucleotide
aagagggagaaagccgtcttaatttgg

SEQ ID NO: 5549 - DNA, 27 bp, Artificial Sequence
  Synthetic oligonucleotide
agagggagaaagccgtcttaatttggt

SEQ ID NO: 5550 - DNA, 27 bp, Artificial Sequence
  Synthetic oligonucleotide
gagggagaaagccgtcttaatttggtc

SEQ ID NO: 5551 - DNA, 27 bp, Artificial Sequence
  Synthetic oligonucleotide
agggagaaagccgtcttaatttggtcc

SEQ ID NO: 5552 - DNA, 27 bp, Artificial Sequence
  Synthetic oligonucleotide
gggagaaagccgtcttaatttggtcca

SEQ ID NO: 5553 - DNA, 27 bp, Artificial Sequence
  Synthetic oligonucleotide
ggagaaagccgtcttaatttggtccag

SEQ ID NO: 5554 - DNA, 27 bp, Artificial Sequence
  Synthetic oligonucleotide
gagaaagccgtcttaatttggtccagc

SEQ ID NO: 5555 - DNA, 27 bp, Artificial Sequence
  Synthetic oligonucleotide
agaaagccgtcttaatttggtccagcg

SEQ ID NO: 5556 - DNA, 27 bp, Artificial Sequence
  Synthetic oligonucleotide
gaaagccgtcttaatttggtccagcgt

SEQ ID NO: 5557 - DNA, 27 bp, Artificial Sequence
  Synthetic oligonucleotide
aaagccgtcttaatttggtccagcgta

SEQ ID NO: 5558 - DNA, 27 bp, Artificial Sequence
  Synthetic oligonucleotide
aagccgtcttaatttggtccagcgtaa

SEQ ID NO: 5559 - DNA, 27 bp, Artificial Sequence
  Synthetic oligonucleotide
agccgtcttaatttggtccagcgtaac

SEQ ID NO: 5560 - DNA, 27 bp, Artificial Sequence
  Synthetic oligonucleotide
gccgtcttaatttggtccagcgtaacg

SEQ ID NO: 5561 - DNA, 27 bp, Artificial Sequence
  Synthetic oligonucleotide
ccgtcttaatttggtccagcgtaacgt

SEQ ID NO: 5562 - DNA, 27 bp, Artificial Sequence
  Synthetic oligonucleotide
cgtcttaatttggtccagcgtaacgtg

SEQ ID NO: 5563 - DNA, 27 bp, Artificial Sequence
  Synthetic oligonucleotide
gtcttaatttggtccagcgtaacgtga

SEQ ID NO: 5564 - DNA, 27 bp, Artificial Sequence
  Synthetic oligonucleotide
tcttaatttggtccagcgtaacgtgaa

SEQ ID NO: 5565 - DNA, 27 bp, Artificial Sequence
  Synthetic oligonucleotide
cttaatttggtccagcgtaacgtgaac

SEQ ID NO: 5566 - DNA, 27 bp, Artificial Sequence
  Synthetic oligonucleotide
ttaatttggtccagcgtaacgtgaaca

SEQ ID NO: 5567 - DNA, 27 bp, Artificial Sequence
  Synthetic oligonucleotide
taatttggtccagcgtaacgtgaacat

SEQ ID NO: 5568 - DNA, 27 bp, Artificial Sequence
  Synthetic oligonucleotide
aatttggtccagcgtaacgtgaacatc

SEQ ID NO: 5569 - DNA, 27 bp, Artificial Sequence
  Synthetic oligonucleotide
atttggtccagcgtaacgtgaacatct

SEQ ID NO: 5570 - DNA, 27 bp, Artificial Sequence
  Synthetic oligonucleotide
tttggtccagcgtaacgtgaacatctt

SEQ ID NO: 5571 - DNA, 27 bp, Artificial Sequence
  Synthetic oligonucleotide
ttggtccagcgtaacgtgaacatcttt

SEQ ID NO: 5572 - DNA, 27 bp, Artificial Sequence
  Synthetic oligonucleotide
tggtccagcgtaacgtgaacatcttta

SEQ ID NO: 5573 - DNA, 27 bp, Artificial Sequence
  Synthetic oligonucleotide
ggtccagcgtaacgtgaacatctttaa

SEQ ID NO: 5574 - DNA, 27 bp, Artificial Sequence
  Synthetic oligonucleotide
gtccagcgtaacgtgaacatctttaaa

SEQ ID NO: 5575 - DNA, 27 bp, Artificial Sequence
  Synthetic oligonucleotide
tccagcgtaacgtgaacatctttaaat

SEQ ID NO: 5576 - DNA, 27 bp, Artificial Sequence
  Synthetic oligonucleotide
ccagcgtaacgtgaacatctttaaatt

SEQ ID NO: 5577 - DNA, 27 bp, Artificial Sequence
  Synthetic oligonucleotide
cagcgtaacgtgaacatctttaaattc

SEQ ID NO: 5578 - DNA, 27 bp, Artificial Sequence
  Synthetic oligonucleotide
agcgtaacgtgaacatctttaaattca

SEQ ID NO: 5579 - DNA, 27 bp, Artificial Sequence
  Synthetic oligonucleotide
gcgtaacgtgaacatctttaaattcat

SEQ ID NO: 5580 - DNA, 27 bp, Artificial Sequence
  Synthetic oligonucleotide
cgtaacgtgaacatctttaaattcatc

SEQ ID NO: 5581 - DNA, 27 bp, Artificial Sequence
  Synthetic oligonucleotide
gtaacgtgaacatctttaaattcatca

SEQ ID NO: 5582 - DNA, 27 bp, Artificial Sequence
  Synthetic oligonucleotide
taacgtgaacatctttaaattcatcat

SEQ ID NO: 5583 - DNA, 27 bp, Artificial Sequence
  Synthetic oligonucleotide
aacgtgaacatctttaaattcatcatt

SEQ ID NO: 5584 - DNA, 27 bp, Artificial Sequence
  Synthetic oligonucleotide
acgtgaacatctttaaattcatcattc

SEQ ID NO: 5585 - DNA, 27 bp, Artificial Sequence
  Synthetic oligonucleotide
cgtgaacatctttaaattcatcattcc

SEQ ID NO: 5586 - DNA, 27 bp, Artificial Sequence
  Synthetic oligonucleotide
gtgaacatctttaaattcatcattcct

SEQ ID NO: 5587 - DNA, 27 bp, Artificial Sequence
  Synthetic oligonucleotide
tgaacatctttaaattcatcattccta

SEQ ID NO: 5588 - DNA, 27 bp, Artificial Sequence
  Synthetic oligonucleotide
gaacatctttaaattcatcattcctaa

SEQ ID NO: 5589 - DNA, 27 bp, Artificial Sequence
  Synthetic oligonucleotide
aacatctttaaattcatcattcctaat

SEQ ID NO: 5590 - DNA, 27 bp, Artificial Sequence
  Synthetic oligonucleotide
acatctttaaattcatcattcctaatg

SEQ ID NO: 5591 - DNA, 27 bp, Artificial Sequence
  Synthetic oligonucleotide
catctttaaattcatcattcctaatgt

SEQ ID NO: 5592 - DNA, 27 bp, Artificial Sequence
  Synthetic oligonucleotide
atctttaaattcatcattcctaatgtt

SEQ ID NO: 5593 - DNA, 27 bp, Artificial Sequence
  Synthetic oligonucleotide
tctttaaattcatcattcctaatgttg

SEQ ID NO: 5594 - DNA, 27 bp, Artificial Sequence
  Synthetic oligonucleotide
ctttaaattcatcattcctaatgttgt

SEQ ID NO: 5595 - DNA, 27 bp, Artificial Sequence
  Synthetic oligonucleotide
tttaaattcatcattcctaatgttgta

SEQ ID NO: 5596 - DNA, 27 bp, Artificial Sequence
  Synthetic oligonucleotide
ttaaattcatcattcctaatgttgtaa

SEQ ID NO: 5597 - DNA, 27 bp, Artificial Sequence
  Synthetic oligonucleotide
taaattcatcattcctaatgttgtaaa

SEQ ID NO: 5598 - DNA, 27 bp, Artificial Sequence
  Synthetic oligonucleotide
aaattcatcattcctaatgttgtaaaa

SEQ ID NO: 5599 - DNA, 27 bp, Artificial Sequence
  Synthetic oligonucleotide
aattcatcattcctaatgttgtaaaat

SEQ ID NO: 5600 - DNA, 27 bp, Artificial Sequence
  Synthetic oligonucleotide
attcatcattcctaatgttgtaaaata

SEQ ID NO: 5601 - DNA, 27 bp, Artificial Sequence
  Synthetic oligonucleotide
ttcatcattcctaatgttgtaaaatac

SEQ ID NO: 5602 - DNA, 27 bp, Artificial Sequence
  Synthetic oligonucleotide
tcatcattcctaatgttgtaaaataca

SEQ ID NO: 5603 - DNA, 27 bp, Artificial Sequence
  Synthetic oligonucleotide
catcattcctaatgttgtaaaatacag

SEQ ID NO: 5604 - DNA, 27 bp, Artificial Sequence
  Synthetic oligonucleotide
atcattcctaatgttgtaaaatacagc

SEQ ID NO: 5605 - DNA, 27 bp, Artificial Sequence
  Synthetic oligonucleotide
tcattcctaatgttgtaaaatacagcc

SEQ ID NO: 5606 - DNA, 27 bp, Artificial Sequence
  Synthetic oligonucleotide
cattcctaatgttgtaaaatacagccc

SEQ ID NO: 5607 - DNA, 27 bp, Artificial Sequence
  Synthetic oligonucleotide
attcctaatgttgtaaaatacagcccg

SEQ ID NO: 5608 - DNA, 27 bp, Artificial Sequence
  Synthetic oligonucleotide
ttcctaatgttgtaaaatacagcccga

SEQ ID NO: 5609 - DNA, 27 bp, Artificial Sequence
  Synthetic oligonucleotide
tcctaatgttgtaaaatacagcccgaa

SEQ ID NO: 5610 - DNA, 27 bp, Artificial Sequence
  Synthetic oligonucleotide
cctaatgttgtaaaatacagcccgaac

SEQ ID NO: 5611 - DNA, 27 bp, Artificial Sequence
  Synthetic oligonucleotide
ctaatgttgtaaaatacagcccgaact

SEQ ID NO: 5612 - DNA, 27 bp, Artificial Sequence
  Synthetic oligonucleotide
taatgttgtaaaatacagcccgaactg

SEQ ID NO: 5613 - DNA, 27 bp, Artificial Sequence
  Synthetic oligonucleotide
aatgttgtaaaatacagcccgaactgc

SEQ ID NO: 5614 - DNA, 27 bp, Artificial Sequence
  Synthetic oligonucleotide
atgttgtaaaatacagcccgaactgca

SEQ ID NO: 5615 - DNA, 27 bp, Artificial Sequence
  Synthetic oligonucleotide
tgttgtaaaatacagcccgaactgcaa

SEQ ID NO: 5616 - DNA, 27 bp, Artificial Sequence
  Synthetic oligonucleotide
gttgtaaaatacagcccgaactgcaag

SEQ ID NO: 5617 - DNA, 27 bp, Artificial Sequence
  Synthetic oligonucleotide
ttgtaaaatacagcccgaactgcaagt

SEQ ID NO: 5618 - DNA, 27 bp, Artificial Sequence
  Synthetic oligonucleotide
tgtaaaatacagcccgaactgcaagtt

SEQ ID NO: 5619 - DNA, 27 bp, Artificial Sequence
  Synthetic oligonucleotide
gtaaaatacagcccgaactgcaagttg

SEQ ID NO: 5620 - DNA, 27 bp, Artificial Sequence
  Synthetic oligonucleotide
taaaatacagcccgaactgcaagttgc

SEQ ID NO: 5621 - DNA, 27 bp, Artificial Sequence
  Synthetic oligonucleotide
aaaatacagcccgaactgcaagttgct

SEQ ID NO: 5622 - DNA, 27 bp, Artificial Sequence
  Synthetic oligonucleotide
aaatacagcccgaactgcaagttgctt

SEQ ID NO: 5623 - DNA, 27 bp, Artificial Sequence
  Synthetic oligonucleotide
aatacagcccgaactgcaagttgctta

SEQ ID NO: 5624 - DNA, 27 bp, Artificial Sequence
  Synthetic oligonucleotide
atacagcccgaactgcaagttgcttat

SEQ ID NO: 5625 - DNA, 27 bp, Artificial Sequence
  Synthetic oligonucleotide
tacagcccgaactgcaagttgcttatt

SEQ ID NO: 5626 - DNA, 27 bp, Artificial Sequence
  Synthetic oligonucleotide
acagcccgaactgcaagttgcttattg

SEQ ID NO: 5627 - DNA, 27 bp, Artificial Sequence
  Synthetic oligonucleotide
cagcccgaactgcaagttgcttattgt

SEQ ID NO: 5628 - DNA, 27 bp, Artificial Sequence
  Synthetic oligonucleotide
agcccgaactgcaagttgcttattgtt

SEQ ID NO: 5629 - DNA, 27 bp, Artificial Sequence
  Synthetic oligonucleotide
gcccgaactgcaagttgcttattgttt

SEQ ID NO: 5630 - DNA, 27 bp, Artificial Sequence
  Synthetic oligonucleotide
cccgaactgcaagttgcttattgtttc

SEQ ID NO: 5631 - DNA, 27 bp, Artificial Sequence
  Synthetic oligonucleotide
ccgaactgcaagttgcttattgtttca

SEQ ID NO: 5632 - DNA, 27 bp, Artificial Sequence
  Synthetic oligonucleotide
cgaactgcaagttgcttattgtttcaa

SEQ ID NO: 5633 - DNA, 27 bp, Artificial Sequence
  Synthetic oligonucleotide
gaactgcaagttgcttattgtttcaaa

SEQ ID NO: 5634 - DNA, 27 bp, Artificial Sequence
  Synthetic oligonucleotide
aactgcaagttgcttattgtttcaaat

SEQ ID NO: 5635 - DNA, 27 bp, Artificial Sequence
  Synthetic oligonucleotide
actgcaagttgcttattgtttcaaatc

SEQ ID NO: 5636 - DNA, 27 bp, Artificial Sequence
  Synthetic oligonucleotide
ctgcaagttgcttattgtttcaaatcc

SEQ ID NO: 5637 - DNA, 27 bp, Artificial Sequence
  Synthetic oligonucleotide
tgcaagttgcttattgtttcaaatcca

SEQ ID NO: 5638 - DNA, 27 bp, Artificial Sequence
  Synthetic oligonucleotide
gcaagttgcttattgtttcaaatccag

SEQ ID NO: 5639 - DNA, 27 bp, Artificial Sequence
  Synthetic oligonucleotide
caagttgcttattgtttcaaatccagt

SEQ ID NO: 5640 - DNA, 27 bp, Artificial Sequence
  Synthetic oligonucleotide
aagttgcttattgtttcaaatccagtg

SEQ ID NO: 5641 - DNA, 27 bp, Artificial Sequence
  Synthetic oligonucleotide
agttgcttattgtttcaaatccagtgg

SEQ ID NO: 5642 - DNA, 27 bp, Artificial Sequence
  Synthetic oligonucleotide
gttgcttattgtttcaaatccagtgga

SEQ ID NO: 5643 - DNA, 27 bp, Artificial Sequence
  Synthetic oligonucleotide
ttgcttattgtttcaaatccagtggat

SEQ ID NO: 5644 - DNA, 27 bp, Artificial Sequence
  Synthetic oligonucleotide
tgcttattgtttcaaatccagtggata

SEQ ID NO: 5645 - DNA, 27 bp, Artificial Sequence
  Synthetic oligonucleotide
gcttattgtttcaaatccagtggatat

SEQ ID NO: 5646 - DNA, 27 bp, Artificial Sequence
  Synthetic oligonucleotide
cttattgtttcaaatccagtggatatc

SEQ ID NO: 5647 - DNA, 27 bp, Artificial Sequence
  Synthetic oligonucleotide
ttattgtttcaaatccagtggatatct

SEQ ID NO: 5648 - DNA, 27 bp, Artificial Sequence
  Synthetic oligonucleotide
tattgtttcaaatccagtggatatctt

SEQ ID NO: 5649 - DNA, 27 bp, Artificial Sequence
  Synthetic oligonucleotide
attgtttcaaatccagtggatatcttg

SEQ ID NO: 5650 - DNA, 27 bp, Artificial Sequence
  Synthetic oligonucleotide
ttgtttcaaatccagtggatatcttga

SEQ ID NO: 5651 - DNA, 27 bp, Artificial Sequence
  Synthetic oligonucleotide
tgtttcaaatccagtggatatcttgac

SEQ ID NO: 5652 - DNA, 27 bp, Artificial Sequence
  Synthetic oligonucleotide
gtttcaaatccagtggatatcttgacc

SEQ ID NO: 5653 - DNA, 27 bp, Artificial Sequence
  Synthetic oligonucleotide
tttcaaatccagtggatatcttgacct

SEQ ID NO: 5654 - DNA, 27 bp, Artificial Sequence
  Synthetic oligonucleotide
ttcaaatccagtggatatcttgaccta

SEQ ID NO: 5655 - DNA, 27 bp, Artificial Sequence
  Synthetic oligonucleotide
tcaaatccagtggatatcttgacctac

SEQ ID NO: 5656 - DNA, 27 bp, Artificial Sequence
  Synthetic oligonucleotide
caaatccagtggatatcttgacctacg

SEQ ID NO: 5657 - DNA, 27 bp, Artificial Sequence
  Synthetic oligonucleotide
aaatccagtggatatcttgacctacgt

SEQ ID NO: 5658 - DNA, 27 bp, Artificial Sequence
  Synthetic oligonucleotide
aatccagtggatatcttgacctacgtg

SEQ ID NO: 5659 - DNA, 27 bp, Artificial Sequence
  Synthetic oligonucleotide
atccagtggatatcttgacctacgtgg

SEQ ID NO: 5660 - DNA, 27 bp, Artificial Sequence
  Synthetic oligonucleotide
tccagtggatatcttgacctacgtggc

SEQ ID NO: 5661 - DNA, 27 bp, Artificial Sequence
  Synthetic oligonucleotide
ccagtggatatcttgacctacgtggct

SEQ ID NO: 5662 - DNA, 27 bp, Artificial Sequence
  Synthetic oligonucleotide
agtggatatcttgacctacgtggcttg

SEQ ID NO: 5663 - DNA, 27 bp, Artificial Sequence
  Synthetic oligonucleotide
gtggatatcttgacctacgtggcttgg

SEQ ID NO: 5664 - DNA, 27 bp, Artificial Sequence
  Synthetic oligonucleotide
tatcttgacctacgtggcttggaagat

SEQ ID NO: 5665 - DNA, 27 bp, Artificial Sequence
  Synthetic oligonucleotide
ttgacctacgtggcttggaagataagt

SEQ ID NO: 5666 - DNA, 27 bp, Artificial Sequence
  Synthetic oligonucleotide
tgacctacgtggcttggaagataagtg

SEQ ID NO: 5667 - DNA, 27 bp, Artificial Sequence
  Synthetic oligonucleotide
gacctacgtggcttggaagataagtgg

SEQ ID NO: 5668 - DNA, 27 bp, Artificial Sequence
  Synthetic oligonucleotide
acctacgtggcttggaagataagtggt

SEQ ID NO: 5669 - DNA, 27 bp, Artificial Sequence
  Synthetic oligonucleotide
cctacgtggcttggaagataagtggtt

SEQ ID NO: 5670 - DNA, 27 bp, Artificial Sequence
  Synthetic oligonucleotide
ctacgtggcttggaagataagtggttt

SEQ ID NO: 5671 - DNA, 27 bp, Artificial Sequence
  Synthetic oligonucleotide
tacgtggcttggaagataagtggtttt

SEQ ID NO: 5672 - DNA, 27 bp, Artificial Sequence
  Synthetic oligonucleotide
acgtggcttggaagataagtggttttc

SEQ ID NO: 5673 - DNA, 27 bp, Artificial Sequence
  Synthetic oligonucleotide
cgtggcttggaagataagtggttttcc

SEQ ID NO: 5674 - DNA, 27 bp, Artificial Sequence
  Synthetic oligonucleotide
gtggcttggaagataagtggttttccc

SEQ ID NO: 5675 - DNA, 27 bp, Artificial Sequence
  Synthetic oligonucleotide
tggcttggaagataagtggttttccca

SEQ ID NO: 5676 - DNA, 27 bp, Artificial Sequence
  Synthetic oligonucleotide
ggcttggaagataagtggttttcccaa

SEQ ID NO: 5677 - DNA, 27 bp, Artificial Sequence
  Synthetic oligonucleotide
gcttggaagataagtggttttcccaaa

SEQ ID NO: 5678 - DNA, 27 bp, Artificial Sequence
  Synthetic oligonucleotide
cttggaagataagtggttttcccaaaa

SEQ ID NO: 5679 - DNA, 27 bp, Artificial Sequence
  Synthetic oligonucleotide
ggaagataagtggttttcccaaaaacc

SEQ ID NO: 5680 - DNA, 27 bp, Artificial Sequence
  Synthetic oligonucleotide
gaagataagtggttttcccaaaaaccg

SEQ ID NO: 5681 - DNA, 27 bp, Artificial Sequence
  Synthetic oligonucleotide
aagataagtggttttcccaaaaaccgt

SEQ ID NO: 5682 - DNA, 27 bp, Artificial Sequence
  Synthetic oligonucleotide
agataagtggttttcccaaaaaccgtg

SEQ ID NO: 5683 - DNA, 27 bp, Artificial Sequence
  Synthetic oligonucleotide
gataagtggttttcccaaaaaccgtgt

SEQ ID NO: 5684 - DNA, 27 bp, Artificial Sequence
  Synthetic oligonucleotide
ataagtggttttcccaaaaaccgtgtt

SEQ ID NO: 5685 - DNA, 27 bp, Artificial Sequence
  Synthetic oligonucleotide
taagtggttttcccaaaaaccgtgtta

SEQ ID NO: 5686 - DNA, 27 bp, Artificial Sequence
  Synthetic oligonucleotide
aagtggttttcccaaaaaccgtgttat

SEQ ID NO: 5687 - DNA, 27 bp, Artificial Sequence
  Synthetic oligonucleotide
agtggttttcccaaaaaccgtgttatt

SEQ ID NO: 5688 - DNA, 27 bp, Artificial Sequence
  Synthetic oligonucleotide
gtggttttcccaaaaaccgtgttattg

SEQ ID NO: 5689 - DNA, 27 bp, Artificial Sequence
  Synthetic oligonucleotide
tggttttcccaaaaaccgtgttattgg

SEQ ID NO: 5690 - DNA, 27 bp, Artificial Sequence
  Synthetic oligonucleotide
ggttttcccaaaaaccgtgttattgga

SEQ ID NO: 5691 - DNA, 27 bp, Artificial Sequence
  Synthetic oligonucleotide
gttttcccaaaaaccgtgttattggaa

SEQ ID NO: 5692 - DNA, 27 bp, Artificial Sequence
  Synthetic oligonucleotide
ttttcccaaaaaccgtgttattggaag

SEQ ID NO: 5693 - DNA, 27 bp, Artificial Sequence
  Synthetic oligonucleotide
tttcccaaaaaccgtgttattggaagc

SEQ ID NO: 5694 - DNA, 27 bp, Artificial Sequence
  Synthetic oligonucleotide
ttcccaaaaaccgtgttattggaagcg

SEQ ID NO: 5695 - DNA, 27 bp, Artificial Sequence
  Synthetic oligonucleotide
tcccaaaaaccgtgttattggaagcgg

SEQ ID NO: 5696 - DNA, 27 bp, Artificial Sequence
  Synthetic oligonucleotide
cccaaaaaccgtgttattggaagcggt

SEQ ID NO: 5697 - DNA, 27 bp, Artificial Sequence
  Synthetic oligonucleotide
ccaaaaaccgtgttattggaagcggtt

SEQ ID NO: 5698 - DNA, 27 bp, Artificial Sequence
  Synthetic oligonucleotide
caaaaaccgtgttattggaagcggttg

SEQ ID NO: 5699 - DNA, 27 bp, Artificial Sequence
  Synthetic oligonucleotide
aaaaaccgtgttattggaagcggttgc

SEQ ID NO: 5700 - DNA, 27 bp, Artificial Sequence
  Synthetic oligonucleotide
aaaaccgtgttattggaagcggttgca

SEQ ID NO: 5701 - DNA, 27 bp, Artificial Sequence
  Synthetic oligonucleotide
aaaccgtgttattggaagcggttgcaa

SEQ ID NO: 5702 - DNA, 27 bp, Artificial Sequence
  Synthetic oligonucleotide
aaccgtgttattggaagcggttgcaat

SEQ ID NO: 5703 - DNA, 27 bp, Artificial Sequence
  Synthetic oligonucleotide
accgtgttattggaagcggttgcaatc

SEQ ID NO: 5704 - DNA, 27 bp, Artificial Sequence
  Synthetic oligonucleotide
ccgtgttattggaagcggttgcaatct

SEQ ID NO: 5705 - DNA, 27 bp, Artificial Sequence
  Synthetic oligonucleotide
cgtgttattggaagcggttgcaatctg

SEQ ID NO: 5706 - DNA, 27 bp, Artificial Sequence
  Synthetic oligonucleotide
gtgttattggaagcggttgcaatctgg

SEQ ID NO: 5707 - DNA, 27 bp, Artificial Sequence
  Synthetic oligonucleotide
tgttattggaagcggttgcaatctgga

SEQ ID NO: 5708 - DNA, 27 bp, Artificial Sequence
  Synthetic oligonucleotide
gttattggaagcggttgcaatctggat

SEQ ID NO: 5709 - DNA, 27 bp, Artificial Sequence
  Synthetic oligonucleotide
ttattggaagcggttgcaatctggatt

SEQ ID NO: 5710 - DNA, 27 bp, Artificial Sequence
  Synthetic oligonucleotide
tattggaagcggttgcaatctggattc

SEQ ID NO: 5711 - DNA, 27 bp, Artificial Sequence
  Synthetic oligonucleotide
attggaagcggttgcaatctggattca

SEQ ID NO: 5712 - DNA, 27 bp, Artificial Sequence
  Synthetic oligonucleotide
ttggaagcggttgcaatctggattcag

SEQ ID NO: 5713 - DNA, 27 bp, Artificial Sequence
  Synthetic oligonucleotide
tggaagcggttgcaatctggattcagc

SEQ ID NO: 5714 - DNA, 27 bp, Artificial Sequence
  Synthetic oligonucleotide
ggaagcggttgcaatctggattcagcc

SEQ ID NO: 5715 - DNA, 27 bp, Artificial Sequence
  Synthetic oligonucleotide
gaagcggttgcaatctggattcagccc

SEQ ID NO: 5716 - DNA, 27 bp, Artificial Sequence
  Synthetic oligonucleotide
aagcggttgcaatctggattcagcccg

SEQ ID NO: 5717 - DNA, 27 bp, Artificial Sequence
  Synthetic oligonucleotide
agcggttgcaatctggattcagcccga

SEQ ID NO: 5718 - DNA, 27 bp, Artificial Sequence
  Synthetic oligonucleotide
gcggttgcaatctggattcagcccgat

SEQ ID NO: 5719 - DNA, 27 bp, Artificial Sequence
  Synthetic oligonucleotide
cggttgcaatctggattcagcccgatt

SEQ ID NO: 5720 - DNA, 27 bp, Artificial Sequence
  Synthetic oligonucleotide
ggttgcaatctggattcagcccgattc

SEQ ID NO: 5721 - DNA, 27 bp, Artificial Sequence
  Synthetic oligonucleotide
gttgcaatctggattcagcccgattcc

SEQ ID NO: 5722 - DNA, 27 bp, Artificial Sequence
  Synthetic oligonucleotide
ttgcaatctggattcagcccgattccg

SEQ ID NO: 5723 - DNA, 27 bp, Artificial Sequence
  Synthetic oligonucleotide
tgcaatctggattcagcccgattccgt

SEQ ID NO: 5724 - DNA, 27 bp, Artificial Sequence
  Synthetic oligonucleotide
gcaatctggattcagcccgattccgtt

SEQ ID NO: 5725 - DNA, 27 bp, Artificial Sequence
  Synthetic oligonucleotide
caatctggattcagcccgattccgtta

SEQ ID NO: 5726 - DNA, 27 bp, Artificial Sequence
  Synthetic oligonucleotide
aatctggattcagcccgattccgttac

SEQ ID NO: 5727 - DNA, 27 bp, Artificial Sequence
  Synthetic oligonucleotide
atctggattcagcccgattccgttacc

SEQ ID NO: 5728 - DNA, 27 bp, Artificial Sequence
  Synthetic oligonucleotide
tctggattcagcccgattccgttacct

SEQ ID NO: 5729 - DNA, 27 bp, Artificial Sequence
  Synthetic oligonucleotide
ctggattcagcccgattccgttaccta

SEQ ID NO: 5730 - DNA, 27 bp, Artificial Sequence
  Synthetic oligonucleotide
tggattcagcccgattccgttacctaa

SEQ ID NO: 5731 - DNA, 27 bp, Artificial Sequence
  Synthetic oligonucleotide
ggattcagcccgattccgttacctaat

SEQ ID NO: 5732 - DNA, 27 bp, Artificial Sequence
  Synthetic oligonucleotide
gattcagcccgattccgttacctaatg

SEQ ID NO: 5733 - DNA, 27 bp, Artificial Sequence
  Synthetic oligonucleotide
attcagcccgattccgttacctaatgg

SEQ ID NO: 5734 - DNA, 27 bp, Artificial Sequence
  Synthetic oligonucleotide
ttcagcccgattccgttacctaatggg

SEQ ID NO: 5735 - DNA, 27 bp, Artificial Sequence
  Synthetic oligonucleotide
tcagcccgattccgttacctaatgggg

SEQ ID NO: 5736 - DNA, 27 bp, Artificial Sequence
  Synthetic oligonucleotide
cagcccgattccgttacctaatggggg

SEQ ID NO: 5737 - DNA, 27 bp, Artificial Sequence
  Synthetic oligonucleotide
agcccgattccgttacctaatggggga

SEQ ID NO: 5738 - DNA, 27 bp, Artificial Sequence
  Synthetic oligonucleotide
gcccgattccgttacctaatgggggaa

SEQ ID NO: 5739 - DNA, 27 bp, Artificial Sequence
  Synthetic oligonucleotide
cccgattccgttacctaatgggggaaa

SEQ ID NO: 5740 - DNA, 27 bp, Artificial Sequence
  Synthetic oligonucleotide
ccgattccgttacctaatgggggaaag

SEQ ID NO: 5741 - DNA, 27 bp, Artificial Sequence
  Synthetic oligonucleotide
cgattccgttacctaatgggggaaagg

SEQ ID NO: 5742 - DNA, 27 bp, Artificial Sequence
  Synthetic oligonucleotide
gattccgttacctaatgggggaaaggc

SEQ ID NO: 5743 - DNA, 27 bp, Artificial Sequence
  Synthetic oligonucleotide
attccgttacctaatgggggaaaggct

SEQ ID NO: 5744 - DNA, 27 bp, Artificial Sequence
  Synthetic oligonucleotide
ttccgttacctaatgggggaaaggctg

SEQ ID NO: 5745 - DNA, 27 bp, Artificial Sequence
  Synthetic oligonucleotide
tccgttacctaatgggggaaaggctgg

SEQ ID NO: 5746 - DNA, 27 bp, Artificial Sequence
  Synthetic oligonucleotide
ccgttacctaatgggggaaaggctggg

SEQ ID NO: 5747 - DNA, 27 bp, Artificial Sequence
  Synthetic oligonucleotide
cgttacctaatgggggaaaggctggga

SEQ ID NO: 5748 - DNA, 27 bp, Artificial Sequence
  Synthetic oligonucleotide
gttacctaatgggggaaaggctgggag

SEQ ID NO: 5749 - DNA, 27 bp, Artificial Sequence
  Synthetic oligonucleotide
ttacctaatgggggaaaggctgggagt

SEQ ID NO: 5750 - DNA, 27 bp, Artificial Sequence
  Synthetic oligonucleotide
tacctaatgggggaaaggctgggagtt

SEQ ID NO: 5751 - DNA, 27 bp, Artificial Sequence
  Synthetic oligonucleotide
acctaatgggggaaaggctgggagttc

SEQ ID NO: 5752 - DNA, 27 bp, Artificial Sequence
  Synthetic oligonucleotide
cctaatgggggaaaggctgggagttca

SEQ ID NO: 5753 - DNA, 27 bp, Artificial Sequence
  Synthetic oligonucleotide
ctaatgggggaaaggctgggagttcac

SEQ ID NO: 5754 - DNA, 27 bp, Artificial Sequence
  Synthetic oligonucleotide
taatgggggaaaggctgggagttcacc

SEQ ID NO: 5755 - DNA, 27 bp, Artificial Sequence
  Synthetic oligonucleotide
aatgggggaaaggctgggagttcaccc

SEQ ID NO: 5756 - DNA, 27 bp, Artificial Sequence
  Synthetic oligonucleotide
atgggggaaaggctgggagttcaccca

SEQ ID NO: 5757 - DNA, 27 bp, Artificial Sequence
  Synthetic oligonucleotide
tgggggaaaggctgggagttcacccat

SEQ ID NO: 5758 - DNA, 27 bp, Artificial Sequence
  Synthetic oligonucleotide
gggggaaaggctgggagttcacccatt

SEQ ID NO: 5759 - DNA, 27 bp, Artificial Sequence
  Synthetic oligonucleotide
ggggaaaggctgggagttcacccatta

SEQ ID NO: 5760 - DNA, 27 bp, Artificial Sequence
  Synthetic oligonucleotide
gggaaaggctgggagttcacccattaa

SEQ ID NO: 5761 - DNA, 27 bp, Artificial Sequence
  Synthetic oligonucleotide
ggaaaggctgggagttcacccattaag

SEQ ID NO: 5762 - DNA, 27 bp, Artificial Sequence
  Synthetic oligonucleotide
gaaaggctgggagttcacccattaagc

SEQ ID NO: 5763 - DNA, 27 bp, Artificial Sequence
  Synthetic oligonucleotide
aaaggctgggagttcacccattaagct

SEQ ID NO: 5764 - DNA, 27 bp, Artificial Sequence
  Synthetic oligonucleotide
aaggctgggagttcacccattaagctg

SEQ ID NO: 5765 - DNA, 27 bp, Artificial Sequence
  Synthetic oligonucleotide
aggctgggagttcacccattaagctgt

SEQ ID NO: 5766 - DNA, 27 bp, Artificial Sequence
  Synthetic oligonucleotide
ggctgggagttcacccattaagctgtc

SEQ ID NO: 5767 - DNA, 27 bp, Artificial Sequence
  Synthetic oligonucleotide
gctgggagttcacccattaagctgtca

SEQ ID NO: 5768 - DNA, 27 bp, Artificial Sequence
  Synthetic oligonucleotide
ctgggagttcacccattaagctgtcat

SEQ ID NO: 5769 - DNA, 27 bp, Artificial Sequence
  Synthetic oligonucleotide
tgggagttcacccattaagctgtcatg

SEQ ID NO: 5770 - DNA, 27 bp, Artificial Sequence
  Synthetic oligonucleotide
gggagttcacccattaagctgtcatgg

SEQ ID NO: 5771 - DNA, 27 bp, Artificial Sequence
  Synthetic oligonucleotide
ggagttcacccattaagctgtcatggg

SEQ ID NO: 5772 - DNA, 27 bp, Artificial Sequence
  Synthetic oligonucleotide
gagttcacccattaagctgtcatgggt

SEQ ID NO: 5773 - DNA, 27 bp, Artificial Sequence
  Synthetic oligonucleotide
agttcacccattaagctgtcatgggtg

SEQ ID NO: 5774 - DNA, 27 bp, Artificial Sequence
  Synthetic oligonucleotide
gttcacccattaagctgtcatgggtgg

SEQ ID NO: 5775 - DNA, 27 bp, Artificial Sequence
  Synthetic oligonucleotide
ttcacccattaagctgtcatgggtggg

SEQ ID NO: 5776 - DNA, 27 bp, Artificial Sequence
  Synthetic oligonucleotide
tcacccattaagctgtcatgggtgggt

SEQ ID NO: 5777 - DNA, 27 bp, Artificial Sequence
  Synthetic oligonucleotide
cacccattaagctgtcatgggtgggtc

SEQ ID NO: 5778 - DNA, 27 bp, Artificial Sequence
  Synthetic oligonucleotide
acccattaagctgtcatgggtgggtcc

SEQ ID NO: 5779 - DNA, 27 bp, Artificial Sequence
  Synthetic oligonucleotide
cccattaagctgtcatgggtgggtcct

SEQ ID NO: 5780 - DNA, 27 bp, Artificial Sequence
  Synthetic oligonucleotide
ccattaagctgtcatgggtgggtcctt

SEQ ID NO: 5781 - DNA, 27 bp, Artificial Sequence
  Synthetic oligonucleotide
cattaagctgtcatgggtgggtccttg

SEQ ID NO: 5782 - DNA, 27 bp, Artificial Sequence
  Synthetic oligonucleotide
attaagctgtcatgggtgggtccttgg

SEQ ID NO: 5783 - DNA, 27 bp, Artificial Sequence
  Synthetic oligonucleotide
ttaagctgtcatgggtgggtccttggg

SEQ ID NO: 5784 - DNA, 27 bp, Artificial Sequence
  Synthetic oligonucleotide
taagctgtcatgggtgggtccttgggg

SEQ ID NO: 5785 - DNA, 27 bp, Artificial Sequence
  Synthetic oligonucleotide
aagctgtcatgggtgggtccttgggga

SEQ ID NO: 5786 - DNA, 27 bp, Artificial Sequence
  Synthetic oligonucleotide
agctgtcatgggtgggtccttggggaa

SEQ ID NO: 5787 - DNA, 27 bp, Artificial Sequence
  Synthetic oligonucleotide
gctgtcatgggtgggtccttggggaac

SEQ ID NO: 5788 - DNA, 27 bp, Artificial Sequence
  Synthetic oligonucleotide
ctgtcatgggtgggtccttggggaaca

SEQ ID NO: 5789 - DNA, 27 bp, Artificial Sequence
  Synthetic oligonucleotide
tgtcatgggtgggtccttggggaacat

SEQ ID NO: 5790 - DNA, 27 bp, Artificial Sequence
  Synthetic oligonucleotide
gtcatgggtgggtccttggggaacatg

SEQ ID NO: 5791 - DNA, 27 bp, Artificial Sequence
  Synthetic oligonucleotide
tcatgggtgggtccttggggaacatgg

SEQ ID NO: 5792 - DNA, 27 bp, Artificial Sequence
  Synthetic oligonucleotide
catgggtgggtccttggggaacatgga

SEQ ID NO: 5793 - DNA, 27 bp, Artificial Sequence
  Synthetic oligonucleotide
atgggtgggtccttggggaacatggag

SEQ ID NO: 5794 - DNA, 27 bp, Artificial Sequence
  Synthetic oligonucleotide
tgggtgggtccttggggaacatggaga

SEQ ID NO: 5795 - DNA, 27 bp, Artificial Sequence
  Synthetic oligonucleotide
gggtgggtccttggggaacatggagat

SEQ ID NO: 5796 - DNA, 27 bp, Artificial Sequence
  Synthetic oligonucleotide
ggtgggtccttggggaacatggagatt

SEQ ID NO: 5797 - DNA, 27 bp, Artificial Sequence
  Synthetic oligonucleotide
gtgggtccttggggaacatggagattc

SEQ ID NO: 5798 - DNA, 27 bp, Artificial Sequence
  Synthetic oligonucleotide
tgggtccttggggaacatggagattcc

SEQ ID NO: 5799 - DNA, 27 bp, Artificial Sequence
  Synthetic oligonucleotide
gggtccttggggaacatggagattcca

SEQ ID NO: 5800 - DNA, 27 bp, Artificial Sequence
  Synthetic oligonucleotide
ggtccttggggaacatggagattccag

SEQ ID NO: 5801 - DNA, 27 bp, Artificial Sequence
  Synthetic oligonucleotide
gtccttggggaacatggagattccagt

SEQ ID NO: 5802 - DNA, 27 bp, Artificial Sequence
  Synthetic oligonucleotide
tccttggggaacatggagattccagtg

SEQ ID NO: 5803 - DNA, 27 bp, Artificial Sequence
  Synthetic oligonucleotide
ccttggggaacatggagattccagtgt

SEQ ID NO: 5804 - DNA, 27 bp, Artificial Sequence
  Synthetic oligonucleotide
cttggggaacatggagattccagtgtg

SEQ ID NO: 5805 - DNA, 27 bp, Artificial Sequence
  Synthetic oligonucleotide
ttggggaacatggagattccagtgtgc

SEQ ID NO: 5806 - DNA, 27 bp, Artificial Sequence
  Synthetic oligonucleotide
tggggaacatggagattccagtgtgcc

SEQ ID NO: 5807 - DNA, 27 bp, Artificial Sequence
  Synthetic oligonucleotide
ggggaacatggagattccagtgtgcct

SEQ ID NO: 5808 - DNA, 27 bp, Artificial Sequence
  Synthetic oligonucleotide
gggaacatggagattccagtgtgcctg

SEQ ID NO: 5809 - DNA, 27 bp, Artificial Sequence
  Synthetic oligonucleotide
ggaacatggagattccagtgtgcctgt

SEQ ID NO: 5810 - DNA, 27 bp, Artificial Sequence
  Synthetic oligonucleotide
gaacatggagattccagtgtgcctgta

SEQ ID NO: 5811 - DNA, 27 bp, Artificial Sequence
  Synthetic oligonucleotide
aacatggagattccagtgtgcctgtat

SEQ ID NO: 5812 - DNA, 27 bp, Artificial Sequence
  Synthetic oligonucleotide
acatggagattccagtgtgcctgtatg

SEQ ID NO: 5813 - DNA, 27 bp, Artificial Sequence
  Synthetic oligonucleotide
catggagattccagtgtgcctgtatgg

SEQ ID NO: 5814 - DNA, 27 bp, Artificial Sequence
  Synthetic oligonucleotide
atggagattccagtgtgcctgtatgga

SEQ ID NO: 5815 - DNA, 27 bp, Artificial Sequence
  Synthetic oligonucleotide
tggagattccagtgtgcctgtatggag

SEQ ID NO: 5816 - DNA, 27 bp, Artificial Sequence
  Synthetic oligonucleotide
ggagattccagtgtgcctgtatggagt

SEQ ID NO: 5817 - DNA, 27 bp, Artificial Sequence
  Synthetic oligonucleotide
gagattccagtgtgcctgtatggagtg

SEQ ID NO: 5818 - DNA, 27 bp, Artificial Sequence
  Synthetic oligonucleotide
agattccagtgtgcctgtatggagtgg

SEQ ID NO: 5819 - DNA, 27 bp, Artificial Sequence
  Synthetic oligonucleotide
gattccagtgtgcctgtatggagtgga

SEQ ID NO: 5820 - DNA, 27 bp, Artificial Sequence
  Synthetic oligonucleotide
attccagtgtgcctgtatggagtggaa

SEQ ID NO: 5821 - DNA, 27 bp, Artificial Sequence
  Synthetic oligonucleotide
ttccagtgtgcctgtatggagtggaat

SEQ ID NO: 5822 - DNA, 27 bp, Artificial Sequence
  Synthetic oligonucleotide
tccagtgtgcctgtatggagtggaatg

SEQ ID NO: 5823 - DNA, 27 bp, Artificial Sequence
  Synthetic oligonucleotide
ccagtgtgcctgtatggagtggaatga

SEQ ID NO: 5824 - DNA, 27 bp, Artificial Sequence
  Synthetic oligonucleotide
cagtgtgcctgtatggagtggaatgaa

SEQ ID NO: 5825 - DNA, 27 bp, Artificial Sequence
  Synthetic oligonucleotide
agtgtgcctgtatggagtggaatgaat

SEQ ID NO: 5826 - DNA, 27 bp, Artificial Sequence
  Synthetic oligonucleotide
gtgtgcctgtatggagtggaatgaatg

SEQ ID NO: 5827 - DNA, 27 bp, Artificial Sequence
  Synthetic oligonucleotide
tgtgcctgtatggagtggaatgaatgt

SEQ ID NO: 5828 - DNA, 27 bp, Artificial Sequence
  Synthetic oligonucleotide
gtgcctgtatggagtggaatgaatgtt

SEQ ID NO: 5829 - DNA, 27 bp, Artificial Sequence
  Synthetic oligonucleotide
cctgtatggagtggaatgaatgttgct

SEQ ID NO: 5830 - DNA, 27 bp, Artificial Sequence
  Synthetic oligonucleotide
ctgtatggagtggaatgaatgttgctg

SEQ ID NO: 5831 - DNA, 27 bp, Artificial Sequence
  Synthetic oligonucleotide
tgtatggagtggaatgaatgttgctgg

SEQ ID NO: 5832 - DNA, 27 bp, Artificial Sequence
  Synthetic oligonucleotide
gtatggagtggaatgaatgttgctggt

SEQ ID NO: 5833 - DNA, 27 bp, Artificial Sequence
  Synthetic oligonucleotide
tatggagtggaatgaatgttgctggtg

SEQ ID NO: 5834 - DNA, 27 bp, Artificial Sequence
  Synthetic oligonucleotide
atggagtggaatgaatgttgctggtgt

SEQ ID NO: 5835 - DNA, 27 bp, Artificial Sequence
  Synthetic oligonucleotide
tggagtggaatgaatgttgctggtgtc

SEQ ID NO: 5836 - DNA, 27 bp, Artificial Sequence
  Synthetic oligonucleotide
ggagtggaatgaatgttgctggtgtct

SEQ ID NO: 5837 - DNA, 27 bp, Artificial Sequence
  Synthetic oligonucleotide
gagtggaatgaatgttgctggtgtctc

SEQ ID NO: 5838 - DNA, 27 bp, Artificial Sequence
  Synthetic oligonucleotide
agtggaatgaatgttgctggtgtctct

SEQ ID NO: 5839 - DNA, 27 bp, Artificial Sequence
  Synthetic oligonucleotide
gtggaatgaatgttgctggtgtctctc

SEQ ID NO: 5840 - DNA, 27 bp, Artificial Sequence
  Synthetic oligonucleotide
tggaatgaatgttgctggtgtctctct

SEQ ID NO: 5841 - DNA, 27 bp, Artificial Sequence
  Synthetic oligonucleotide
ggaatgaatgttgctggtgtctctctg

SEQ ID NO: 5842 - DNA, 27 bp, Artificial Sequence
  Synthetic oligonucleotide
gaatgaatgttgctggtgtctctctga

SEQ ID NO: 5843 - DNA, 27 bp, Artificial Sequence
  Synthetic oligonucleotide
atgaatgttgctggtgtctctctgaag

SEQ ID NO: 5844 - DNA, 27 bp, Artificial Sequence
  Synthetic oligonucleotide
tgaatgttgctggtgtctctctgaaga

SEQ ID NO: 5845 - DNA, 27 bp, Artificial Sequence
  Synthetic oligonucleotide
gaatgttgctggtgtctctctgaagac

SEQ ID NO: 5846 - DNA, 27 bp, Artificial Sequence
  Synthetic oligonucleotide
aatgttgctggtgtctctctgaagact

SEQ ID NO: 5847 - DNA, 27 bp, Artificial Sequence
  Synthetic oligonucleotide
atgttgctggtgtctctctgaagactc

SEQ ID NO: 5848 - DNA, 27 bp, Artificial Sequence
  Synthetic oligonucleotide
tgttgctggtgtctctctgaagactct

SEQ ID NO: 5849 - DNA, 27 bp, Artificial Sequence
  Synthetic oligonucleotide
gttgctggtgtctctctgaagactctg

SEQ ID NO: 5850 - DNA, 27 bp, Artificial Sequence
  Synthetic oligonucleotide
ttgctggtgtctctctgaagactctgc

SEQ ID NO: 5851 - DNA, 27 bp, Artificial Sequence
  Synthetic oligonucleotide
tgctggtgtctctctgaagactctgca

SEQ ID NO: 5852 - DNA, 27 bp, Artificial Sequence
  Synthetic oligonucleotide
gctggtgtctctctgaagactctgcac

SEQ ID NO: 5853 - DNA, 27 bp, Artificial Sequence
  Synthetic oligonucleotide
ctggtgtctctctgaagactctgcacc

SEQ ID NO: 5854 - DNA, 27 bp, Artificial Sequence
  Synthetic oligonucleotide
tggtgtctctctgaagactctgcaccc

SEQ ID NO: 5855 - DNA, 27 bp, Artificial Sequence
  Synthetic oligonucleotide
ggtgtctctctgaagactctgcaccca

SEQ ID NO: 5856 - DNA, 27 bp, Artificial Sequence
  Synthetic oligonucleotide
gtgtctctctgaagactctgcacccag

SEQ ID NO: 5857 - DNA, 27 bp, Artificial Sequence
  Synthetic oligonucleotide
tgtctctctgaagactctgcacccaga

SEQ ID NO: 5858 - DNA, 27 bp, Artificial Sequence
  Synthetic oligonucleotide
gtctctctgaagactctgcacccagat

SEQ ID NO: 5859 - DNA, 27 bp, Artificial Sequence
  Synthetic oligonucleotide
tctctctgaagactctgcacccagatt

SEQ ID NO: 5860 - DNA, 27 bp, Artificial Sequence
  Synthetic oligonucleotide
ctctctgaagactctgcacccagattt

SEQ ID NO: 5861 - DNA, 27 bp, Artificial Sequence
  Synthetic oligonucleotide
tctctgaagactctgcacccagattta

SEQ ID NO: 5862 - DNA, 27 bp, Artificial Sequence
  Synthetic oligonucleotide
ctctgaagactctgcacccagatttag

SEQ ID NO: 5863 - DNA, 27 bp, Artificial Sequence
  Synthetic oligonucleotide
tctgaagactctgcacccagatttagg

SEQ ID NO: 5864 - DNA, 27 bp, Artificial Sequence
  Synthetic oligonucleotide
ctgaagactctgcacccagatttaggg

SEQ ID NO: 5865 - DNA, 27 bp, Artificial Sequence
  Synthetic oligonucleotide
tgaagactctgcacccagatttaggga

SEQ ID NO: 5866 - DNA, 27 bp, Artificial Sequence
  Synthetic oligonucleotide
gaagactctgcacccagatttagggac

SEQ ID NO: 5867 - DNA, 27 bp, Artificial Sequence
  Synthetic oligonucleotide
aagactctgcacccagatttagggact

SEQ ID NO: 5868 - DNA, 27 bp, Artificial Sequence
  Synthetic oligonucleotide
agactctgcacccagatttagggactg

SEQ ID NO: 5869 - DNA, 27 bp, Artificial Sequence
  Synthetic oligonucleotide
gactctgcacccagatttagggactga

SEQ ID NO: 5870 - DNA, 27 bp, Artificial Sequence
  Synthetic oligonucleotide
actctgcacccagatttagggactgat

SEQ ID NO: 5871 - DNA, 27 bp, Artificial Sequence
  Synthetic oligonucleotide
ctctgcacccagatttagggactgata

SEQ ID NO: 5872 - DNA, 27 bp, Artificial Sequence
  Synthetic oligonucleotide
tctgcacccagatttagggactgataa

SEQ ID NO: 5873 - DNA, 27 bp, Artificial Sequence
  Synthetic oligonucleotide
ctgcacccagatttagggactgataaa

SEQ ID NO: 5874 - DNA, 27 bp, Artificial Sequence
  Synthetic oligonucleotide
tgcacccagatttagggactgataaag

SEQ ID NO: 5875 - DNA, 27 bp, Artificial Sequence
  Synthetic oligonucleotide
gcacccagatttagggactgataaaga

SEQ ID NO: 5876 - DNA, 27 bp, Artificial Sequence
  Synthetic oligonucleotide
cacccagatttagggactgataaagat

SEQ ID NO: 5877 - DNA, 27 bp, Artificial Sequence
  Synthetic oligonucleotide
acccagatttagggactgataaagata

SEQ ID NO: 5878 - DNA, 27 bp, Artificial Sequence
  Synthetic oligonucleotide
cccagatttagggactgataaagataa

SEQ ID NO: 5879 - DNA, 27 bp, Artificial Sequence
  Synthetic oligonucleotide
ccagatttagggactgataaagataag

SEQ ID NO: 5880 - DNA, 27 bp, Artificial Sequence
  Synthetic oligonucleotide
cagatttagggactgataaagataagg

SEQ ID NO: 5881 - DNA, 27 bp, Artificial Sequence
  Synthetic oligonucleotide
agatttagggactgataaagataagga

SEQ ID NO: 5882 - DNA, 27 bp, Artificial Sequence
  Synthetic oligonucleotide
gatttagggactgataaagataaggaa

SEQ ID NO: 5883 - DNA, 27 bp, Artificial Sequence
  Synthetic oligonucleotide
atttagggactgataaagataaggaac

SEQ ID NO: 5884 - DNA, 27 bp, Artificial Sequence
  Synthetic oligonucleotide
tttagggactgataaagataaggaaca

SEQ ID NO: 5885 - DNA, 27 bp, Artificial Sequence
  Synthetic oligonucleotide
ttagggactgataaagataaggaacag

SEQ ID NO: 5886 - DNA, 27 bp, Artificial Sequence
  Synthetic oligonucleotide
tagggactgataaagataaggaacagt

SEQ ID NO: 5887 - DNA, 27 bp, Artificial Sequence
  Synthetic oligonucleotide
gggactgataaagataaggaacagtgg

SEQ ID NO: 5888 - DNA, 27 bp, Artificial Sequence
  Synthetic oligonucleotide
ggactgataaagataaggaacagtgga

SEQ ID NO: 5889 - DNA, 27 bp, Artificial Sequence
  Synthetic oligonucleotide
gactgataaagataaggaacagtggaa

SEQ ID NO: 5890 - DNA, 27 bp, Artificial Sequence
  Synthetic oligonucleotide
actgataaagataaggaacagtggaaa

SEQ ID NO: 5891 - DNA, 27 bp, Artificial Sequence
  Synthetic oligonucleotide
ctgataaagataaggaacagtggaaag

SEQ ID NO: 5892 - DNA, 27 bp, Artificial Sequence
  Synthetic oligonucleotide
tgataaagataaggaacagtggaaaga

SEQ ID NO: 5893 - DNA, 27 bp, Artificial Sequence
  Synthetic oligonucleotide
gataaagataaggaacagtggaaagag

SEQ ID NO: 5894 - DNA, 27 bp, Artificial Sequence
  Synthetic oligonucleotide
ataaagataaggaacagtggaaagagg

SEQ ID NO: 5895 - DNA, 27 bp, Artificial Sequence
  Synthetic oligonucleotide
taaagataaggaacagtggaaagaggt

SEQ ID NO: 5896 - DNA, 27 bp, Artificial Sequence
  Synthetic oligonucleotide
aaagataaggaacagtggaaagaggtt

SEQ ID NO: 5897 - DNA, 27 bp, Artificial Sequence
  Synthetic oligonucleotide
aagataaggaacagtggaaagaggttc

SEQ ID NO: 5898 - DNA, 27 bp, Artificial Sequence
  Synthetic oligonucleotide
agataaggaacagtggaaagaggttca

SEQ ID NO: 5899 - DNA, 27 bp, Artificial Sequence
  Synthetic oligonucleotide
gataaggaacagtggaaagaggttcac

SEQ ID NO: 5900 - DNA, 27 bp, Artificial Sequence
  Synthetic oligonucleotide
ataaggaacagtggaaagaggttcaca

SEQ ID NO: 5901 - DNA, 27 bp, Artificial Sequence
  Synthetic oligonucleotide
taaggaacagtggaaagaggttcacaa

SEQ ID NO: 5902 - DNA, 27 bp, Artificial Sequence
  Synthetic oligonucleotide
aaggaacagtggaaagaggttcacaag

SEQ ID NO: 5903 - DNA, 27 bp, Artificial Sequence
  Synthetic oligonucleotide
aggaacagtggaaagaggttcacaagc

SEQ ID NO: 5904 - DNA, 27 bp, Artificial Sequence
  Synthetic oligonucleotide
ggaacagtggaaagaggttcacaagca

SEQ ID NO: 5905 - DNA, 27 bp, Artificial Sequence
  Synthetic oligonucleotide
gaacagtggaaagaggttcacaagcag

SEQ ID NO: 5906 - DNA, 27 bp, Artificial Sequence
  Synthetic oligonucleotide
aacagtggaaagaggttcacaagcagg

SEQ ID NO: 5907 - DNA, 27 bp, Artificial Sequence
  Synthetic oligonucleotide
acagtggaaagaggttcacaagcaggt

SEQ ID NO: 5908 - DNA, 27 bp, Artificial Sequence
  Synthetic oligonucleotide
cagtggaaagaggttcacaagcaggtg

SEQ ID NO: 5909 - DNA, 27 bp, Artificial Sequence
  Synthetic oligonucleotide
agtggaaagaggttcacaagcaggtgg

SEQ ID NO: 5910 - DNA, 27 bp, Artificial Sequence
  Synthetic oligonucleotide
gtggaaagaggttcacaagcaggtggt

SEQ ID NO: 5911 - DNA, 27 bp, Artificial Sequence
  Synthetic oligonucleotide
tggaaagaggttcacaagcaggtggtt

SEQ ID NO: 5912 - DNA, 27 bp, Artificial Sequence
  Synthetic oligonucleotide
ggaaagaggttcacaagcaggtggttg

SEQ ID NO: 5913 - DNA, 27 bp, Artificial Sequence
  Synthetic oligonucleotide
gaaagaggttcacaagcaggtggttga

SEQ ID NO: 5914 - DNA, 27 bp, Artificial Sequence
  Synthetic oligonucleotide
aaagaggttcacaagcaggtggttgag

SEQ ID NO: 5915 - DNA, 27 bp, Artificial Sequence
  Synthetic oligonucleotide
aagaggttcacaagcaggtggttgaga

SEQ ID NO: 5916 - DNA, 27 bp, Artificial Sequence
  Synthetic oligonucleotide
agaggttcacaagcaggtggttgagag

SEQ ID NO: 5917 - DNA, 27 bp, Artificial Sequence
  Synthetic oligonucleotide
gaggttcacaagcaggtggttgagagt

SEQ ID NO: 5918 - DNA, 27 bp, Artificial Sequence
  Synthetic oligonucleotide
aggttcacaagcaggtggttgagagtg

SEQ ID NO: 5919 - DNA, 27 bp, Artificial Sequence
  Synthetic oligonucleotide
ggttcacaagcaggtggttgagagtgc

SEQ ID NO: 5920 - DNA, 27 bp, Artificial Sequence
  Synthetic oligonucleotide
gttcacaagcaggtggttgagagtgct

SEQ ID NO: 5921 - DNA, 27 bp, Artificial Sequence
  Synthetic oligonucleotide
ttcacaagcaggtggttgagagtgctt

SEQ ID NO: 5922 - DNA, 27 bp, Artificial Sequence
  Synthetic oligonucleotide
tcacaagcaggtggttgagagtgctta

SEQ ID NO: 5923 - DNA, 27 bp, Artificial Sequence
  Synthetic oligonucleotide
cacaagcaggtggttgagagtgcttat

SEQ ID NO: 5924 - DNA, 27 bp, Artificial Sequence
  Synthetic oligonucleotide
acaagcaggtggttgagagtgcttatg

SEQ ID NO: 5925 - DNA, 27 bp, Artificial Sequence
  Synthetic oligonucleotide
caagcaggtggttgagagtgcttatga

SEQ ID NO: 5926 - DNA, 27 bp, Artificial Sequence
  Synthetic oligonucleotide
aagcaggtggttgagagtgcttatgag

SEQ ID NO: 5927 - DNA, 27 bp, Artificial Sequence
  Synthetic oligonucleotide
agcaggtggttgagagtgcttatgagg

SEQ ID NO: 5928 - DNA, 27 bp, Artificial Sequence
  Synthetic oligonucleotide
gcaggtggttgagagtgcttatgaggt

SEQ ID NO: 5929 - DNA, 27 bp, Artificial Sequence
  Synthetic oligonucleotide
caggtggttgagagtgcttatgaggtg

SEQ ID NO: 5930 - DNA, 27 bp, Artificial Sequence
  Synthetic oligonucleotide
aggtggttgagagtgcttatgaggtga

SEQ ID NO: 5931 - DNA, 27 bp, Artificial Sequence
  Synthetic oligonucleotide
ggtggttgagagtgcttatgaggtgat

SEQ ID NO: 5932 - DNA, 27 bp, Artificial Sequence
  Synthetic oligonucleotide
gtggttgagagtgcttatgaggtgatc

SEQ ID NO: 5933 - DNA, 27 bp, Artificial Sequence
  Synthetic oligonucleotide
tggttgagagtgcttatgaggtgatca

SEQ ID NO: 5934 - DNA, 27 bp, Artificial Sequence
  Synthetic oligonucleotide
ggttgagagtgcttatgaggtgatcaa

SEQ ID NO: 5935 - DNA, 27 bp, Artificial Sequence
  Synthetic oligonucleotide
gttgagagtgcttatgaggtgatcaaa

SEQ ID NO: 5936 - DNA, 27 bp, Artificial Sequence
  Synthetic oligonucleotide
ttgagagtgcttatgaggtgatcaaac

SEQ ID NO: 5937 - DNA, 27 bp, Artificial Sequence
  Synthetic oligonucleotide
tgagagtgcttatgaggtgatcaaact

SEQ ID NO: 5938 - DNA, 27 bp, Artificial Sequence
  Synthetic oligonucleotide
gagagtgcttatgaggtgatcaaactc

SEQ ID NO: 5939 - DNA, 27 bp, Artificial Sequence
  Synthetic oligonucleotide
agagtgcttatgaggtgatcaaactca

SEQ ID NO: 5940 - DNA, 27 bp, Artificial Sequence
  Synthetic oligonucleotide
gagtgcttatgaggtgatcaaactcaa

SEQ ID NO: 5941 - DNA, 27 bp, Artificial Sequence
  Synthetic oligonucleotide
agtgcttatgaggtgatcaaactcaaa

SEQ ID NO: 5942 - DNA, 27 bp, Artificial Sequence
  Synthetic oligonucleotide
gtgcttatgaggtgatcaaactcaaag

SEQ ID NO: 5943 - DNA, 27 bp, Artificial Sequence
  Synthetic oligonucleotide
tgcttatgaggtgatcaaactcaaagg

SEQ ID NO: 5944 - DNA, 27 bp, Artificial Sequence
  Synthetic oligonucleotide
gcttatgaggtgatcaaactcaaaggc

SEQ ID NO: 5945 - DNA, 27 bp, Artificial Sequence
  Synthetic oligonucleotide
cttatgaggtgatcaaactcaaaggct

SEQ ID NO: 5946 - DNA, 27 bp, Artificial Sequence
  Synthetic oligonucleotide
ttatgaggtgatcaaactcaaaggcta

SEQ ID NO: 5947 - DNA, 27 bp, Artificial Sequence
  Synthetic oligonucleotide
tatgaggtgatcaaactcaaaggctac

SEQ ID NO: 5948 - DNA, 27 bp, Artificial Sequence
  Synthetic oligonucleotide
atgaggtgatcaaactcaaaggctaca

SEQ ID NO: 5949 - DNA, 27 bp, Artificial Sequence
  Synthetic oligonucleotide
tgaggtgatcaaactcaaaggctacac

SEQ ID NO: 5950 - DNA, 27 bp, Artificial Sequence
  Synthetic oligonucleotide
gaggtgatcaaactcaaaggctacaca

SEQ ID NO: 5951 - DNA, 27 bp, Artificial Sequence
  Synthetic oligonucleotide
aggtgatcaaactcaaaggctacacat

SEQ ID NO: 5952 - DNA, 27 bp, Artificial Sequence
  Synthetic oligonucleotide
ggtgatcaaactcaaaggctacacatc

SEQ ID NO: 5953 - DNA, 27 bp, Artificial Sequence
  Synthetic oligonucleotide
gtgatcaaactcaaaggctacacatcc

SEQ ID NO: 5954 - DNA, 27 bp, Artificial Sequence
  Synthetic oligonucleotide
tgatcaaactcaaaggctacacatcct

SEQ ID NO: 5955 - DNA, 27 bp, Artificial Sequence
  Synthetic oligonucleotide
gatcaaactcaaaggctacacatcctg

SEQ ID NO: 5956 - DNA, 27 bp, Artificial Sequence
  Synthetic oligonucleotide
atcaaactcaaaggctacacatcctgg

SEQ ID NO: 5957 - DNA, 27 bp, Artificial Sequence
  Synthetic oligonucleotide
tcaaactcaaaggctacacatcctggg

SEQ ID NO: 5958 - DNA, 27 bp, Artificial Sequence
  Synthetic oligonucleotide
caaactcaaaggctacacatcctgggc

SEQ ID NO: 5959 - DNA, 27 bp, Artificial Sequence
  Synthetic oligonucleotide
aaactcaaaggctacacatcctgggct

SEQ ID NO: 5960 - DNA, 27 bp, Artificial Sequence
  Synthetic oligonucleotide
aactcaaaggctacacatcctgggcta

SEQ ID NO: 5961 - DNA, 27 bp, Artificial Sequence
  Synthetic oligonucleotide
actcaaaggctacacatcctgggctat

SEQ ID NO: 5962 - DNA, 27 bp, Artificial Sequence
  Synthetic oligonucleotide
ctcaaaggctacacatcctgggctatt

SEQ ID NO: 5963 - DNA, 27 bp, Artificial Sequence
  Synthetic oligonucleotide
tcaaaggctacacatcctgggctattg

SEQ ID NO: 5964 - DNA, 27 bp, Artificial Sequence
  Synthetic oligonucleotide
caaaggctacacatcctgggctattgg

SEQ ID NO: 5965 - DNA, 27 bp, Artificial Sequence
  Synthetic oligonucleotide
aaaggctacacatcctgggctattgga

SEQ ID NO: 5966 - DNA, 27 bp, Artificial Sequence
  Synthetic oligonucleotide
aaggctacacatcctgggctattggac

SEQ ID NO: 5967 - DNA, 27 bp, Artificial Sequence
  Synthetic oligonucleotide
aggctacacatcctgggctattggact

SEQ ID NO: 5968 - DNA, 27 bp, Artificial Sequence
  Synthetic oligonucleotide
ggctacacatcctgggctattggactc

SEQ ID NO: 5969 - DNA, 27 bp, Artificial Sequence
  Synthetic oligonucleotide
gctacacatcctgggctattggactct

SEQ ID NO: 5970 - DNA, 27 bp, Artificial Sequence
  Synthetic oligonucleotide
ctacacatcctgggctattggactctc

SEQ ID NO: 5971 - DNA, 27 bp, Artificial Sequence
  Synthetic oligonucleotide
tacacatcctgggctattggactctct

SEQ ID NO: 5972 - DNA, 27 bp, Artificial Sequence
  Synthetic oligonucleotide
acacatcctgggctattggactctctg

SEQ ID NO: 5973 - DNA, 27 bp, Artificial Sequence
  Synthetic oligonucleotide
cacatcctgggctattggactctctgt

SEQ ID NO: 5974 - DNA, 27 bp, Artificial Sequence
  Synthetic oligonucleotide
acatcctgggctattggactctctgta

SEQ ID NO: 5975 - DNA, 27 bp, Artificial Sequence
  Synthetic oligonucleotide
catcctgggctattggactctctgtag

SEQ ID NO: 5976 - DNA, 27 bp, Artificial Sequence
  Synthetic oligonucleotide
atcctgggctattggactctctgtagc

SEQ ID NO: 5977 - DNA, 27 bp, Artificial Sequence
  Synthetic oligonucleotide
tcctgggctattggactctctgtagca

SEQ ID NO: 5978 - DNA, 27 bp, Artificial Sequence
  Synthetic oligonucleotide
cctgggctattggactctctgtagcag

SEQ ID NO: 5979 - DNA, 27 bp, Artificial Sequence
  Synthetic oligonucleotide
ctgggctattggactctctgtagcaga

SEQ ID NO: 5980 - DNA, 27 bp, Artificial Sequence
  Synthetic oligonucleotide
tgggctattggactctctgtagcagat

SEQ ID NO: 5981 - DNA, 27 bp, Artificial Sequence
  Synthetic oligonucleotide
gggctattggactctctgtagcagatt

SEQ ID NO: 5982 - DNA, 27 bp, Artificial Sequence
  Synthetic oligonucleotide
ggctattggactctctgtagcagattt

SEQ ID NO: 5983 - DNA, 27 bp, Artificial Sequence
  Synthetic oligonucleotide
gctattggactctctgtagcagatttg

SEQ ID NO: 5984 - DNA, 27 bp, Artificial Sequence
  Synthetic oligonucleotide
ctattggactctctgtagcagatttgg

SEQ ID NO: 5985 - DNA, 27 bp, Artificial Sequence
  Synthetic oligonucleotide
tattggactctctgtagcagatttggc

SEQ ID NO: 5986 - DNA, 27 bp, Artificial Sequence
  Synthetic oligonucleotide
attggactctctgtagcagatttggca

SEQ ID NO: 5987 - DNA, 27 bp, Artificial Sequence
  Synthetic oligonucleotide
ttggactctctgtagcagatttggcag

SEQ ID NO: 5988 - DNA, 27 bp, Artificial Sequence
  Synthetic oligonucleotide
tggactctctgtagcagatttggcaga

SEQ ID NO: 5989 - DNA, 27 bp, Artificial Sequence
  Synthetic oligonucleotide
ggactctctgtagcagatttggcagag

SEQ ID NO: 5990 - DNA, 27 bp, Artificial Sequence
  Synthetic oligonucleotide
gactctctgtagcagatttggcagaga

SEQ ID NO: 5991 - DNA, 27 bp, Artificial Sequence
  Synthetic oligonucleotide
actctctgtagcagatttggcagagag

SEQ ID NO: 5992 - DNA, 27 bp, Artificial Sequence
  Synthetic oligonucleotide
ctctctgtagcagatttggcagagagt

SEQ ID NO: 5993 - DNA, 27 bp, Artificial Sequence
  Synthetic oligonucleotide
tctctgtagcagatttggcagagagta

SEQ ID NO: 5994 - DNA, 27 bp, Artificial Sequence
  Synthetic oligonucleotide
ctctgtagcagatttggcagagagtat

SEQ ID NO: 5995 - DNA, 27 bp, Artificial Sequence
  Synthetic oligonucleotide
tctgtagcagatttggcagagagtata

SEQ ID NO: 5996 - DNA, 27 bp, Artificial Sequence
  Synthetic oligonucleotide
ctgtagcagatttggcagagagtataa

SEQ ID NO: 5997 - DNA, 27 bp, Artificial Sequence
  Synthetic oligonucleotide
tgtagcagatttggcagagagtataat

SEQ ID NO: 5998 - DNA, 27 bp, Artificial Sequence
  Synthetic oligonucleotide
gtagcagatttggcagagagtataatg

SEQ ID NO: 5999 - DNA, 27 bp, Artificial Sequence
  Synthetic oligonucleotide
tagcagatttggcagagagtataatga

SEQ ID NO: 6000 - DNA, 27 bp, Artificial Sequence
  Synthetic oligonucleotide
agcagatttggcagagagtataatgaa

SEQ ID NO: 6001 - DNA, 27 bp, Artificial Sequence
  Synthetic oligonucleotide
gcagatttggcagagagtataatgaag

SEQ ID NO: 6002 - DNA, 27 bp, Artificial Sequence
  Synthetic oligonucleotide
cagatttggcagagagtataatgaaga

SEQ ID NO: 6003 - DNA, 27 bp, Artificial Sequence
  Synthetic oligonucleotide
agatttggcagagagtataatgaagaa

SEQ ID NO: 6004 - DNA, 27 bp, Artificial Sequence
  Synthetic oligonucleotide
gatttggcagagagtataatgaagaat

SEQ ID NO: 6005 - DNA, 27 bp, Artificial Sequence
  Synthetic oligonucleotide
atttggcagagagtataatgaagaatc

SEQ ID NO: 6006 - DNA, 27 bp, Artificial Sequence
  Synthetic oligonucleotide
tttggcagagagtataatgaagaatct

SEQ ID NO: 6007 - DNA, 27 bp, Artificial Sequence
  Synthetic oligonucleotide
ttggcagagagtataatgaagaatctt

SEQ ID NO: 6008 - DNA, 27 bp, Artificial Sequence
  Synthetic oligonucleotide
tggcagagagtataatgaagaatctta

SEQ ID NO: 6009 - DNA, 27 bp, Artificial Sequence
  Synthetic oligonucleotide
ggcagagagtataatgaagaatcttag

SEQ ID NO: 6010 - DNA, 27 bp, Artificial Sequence
  Synthetic oligonucleotide
gcagagagtataatgaagaatcttagg

SEQ ID NO: 6011 - DNA, 27 bp, Artificial Sequence
  Synthetic oligonucleotide
cagagagtataatgaagaatcttaggc

SEQ ID NO: 6012 - DNA, 27 bp, Artificial Sequence
  Synthetic oligonucleotide
agagagtataatgaagaatcttaggcg

SEQ ID NO: 6013 - DNA, 27 bp, Artificial Sequence
  Synthetic oligonucleotide
gagagtataatgaagaatcttaggcgg

SEQ ID NO: 6014 - DNA, 27 bp, Artificial Sequence
  Synthetic oligonucleotide
agagtataatgaagaatcttaggcggg

SEQ ID NO: 6015 - DNA, 27 bp, Artificial Sequence
  Synthetic oligonucleotide
gagtataatgaagaatcttaggcgggt

SEQ ID NO: 6016 - DNA, 27 bp, Artificial Sequence
  Synthetic oligonucleotide
agtataatgaagaatcttaggcgggtg

SEQ ID NO: 6017 - DNA, 27 bp, Artificial Sequence
  Synthetic oligonucleotide
gtataatgaagaatcttaggcgggtgc

SEQ ID NO: 6018 - DNA, 27 bp, Artificial Sequence
  Synthetic oligonucleotide
tataatgaagaatcttaggcgggtgca

SEQ ID NO: 6019 - DNA, 27 bp, Artificial Sequence
  Synthetic oligonucleotide
ataatgaagaatcttaggcgggtgcac

SEQ ID NO: 6020 - DNA, 27 bp, Artificial Sequence
  Synthetic oligonucleotide
taatgaagaatcttaggcgggtgcacc

SEQ ID NO: 6021 - DNA, 27 bp, Artificial Sequence
  Synthetic oligonucleotide
aatgaagaatcttaggcgggtgcaccc

SEQ ID NO: 6022 - DNA, 27 bp, Artificial Sequence
  Synthetic oligonucleotide
atgaagaatcttaggcgggtgcaccca

SEQ ID NO: 6023 - DNA, 27 bp, Artificial Sequence
  Synthetic oligonucleotide
tgaagaatcttaggcgggtgcacccag

SEQ ID NO: 6024 - DNA, 27 bp, Artificial Sequence
  Synthetic oligonucleotide
gaagaatcttaggcgggtgcacccagt

SEQ ID NO: 6025 - DNA, 27 bp, Artificial Sequence
  Synthetic oligonucleotide
aagaatcttaggcgggtgcacccagtt

SEQ ID NO: 6026 - DNA, 27 bp, Artificial Sequence
  Synthetic oligonucleotide
agaatcttaggcgggtgcacccagttt

SEQ ID NO: 6027 - DNA, 27 bp, Artificial Sequence
  Synthetic oligonucleotide
gaatcttaggcgggtgcacccagtttc

SEQ ID NO: 6028 - DNA, 27 bp, Artificial Sequence
  Synthetic oligonucleotide
aatcttaggcgggtgcacccagtttcc

SEQ ID NO: 6029 - DNA, 27 bp, Artificial Sequence
  Synthetic oligonucleotide
atcttaggcgggtgcacccagtttcca

SEQ ID NO: 6030 - DNA, 27 bp, Artificial Sequence
  Synthetic oligonucleotide
tcttaggcgggtgcacccagtttccac

SEQ ID NO: 6031 - DNA, 27 bp, Artificial Sequence
  Synthetic oligonucleotide
cttaggcgggtgcacccagtttccacc

SEQ ID NO: 6032 - DNA, 27 bp, Artificial Sequence
  Synthetic oligonucleotide
ttaggcgggtgcacccagtttccacca

SEQ ID NO: 6033 - DNA, 27 bp, Artificial Sequence
  Synthetic oligonucleotide
taggcgggtgcacccagtttccaccat

SEQ ID NO: 6034 - DNA, 27 bp, Artificial Sequence
  Synthetic oligonucleotide
aggcgggtgcacccagtttccaccatg

SEQ ID NO: 6035 - DNA, 27 bp, Artificial Sequence
  Synthetic oligonucleotide
ggcgggtgcacccagtttccaccatga

SEQ ID NO: 6036 - DNA, 27 bp, Artificial Sequence
  Synthetic oligonucleotide
gcgggtgcacccagtttccaccatgat

SEQ ID NO: 6037 - DNA, 27 bp, Artificial Sequence
  Synthetic oligonucleotide
cgggtgcacccagtttccaccatgatt

SEQ ID NO: 6038 - DNA, 27 bp, Artificial Sequence
  Synthetic oligonucleotide
gggtgcacccagtttccaccatgatta

SEQ ID NO: 6039 - DNA, 27 bp, Artificial Sequence
  Synthetic oligonucleotide
ggtgcacccagtttccaccatgattaa

SEQ ID NO: 6040 - DNA, 27 bp, Artificial Sequence
  Synthetic oligonucleotide
gtgcacccagtttccaccatgattaag

SEQ ID NO: 6041 - DNA, 27 bp, Artificial Sequence
  Synthetic oligonucleotide
tgcacccagtttccaccatgattaagg

SEQ ID NO: 6042 - DNA, 27 bp, Artificial Sequence
  Synthetic oligonucleotide
gcacccagtttccaccatgattaaggg

SEQ ID NO: 6043 - DNA, 27 bp, Artificial Sequence
  Synthetic oligonucleotide
cacccagtttccaccatgattaagggt

SEQ ID NO: 6044 - DNA, 27 bp, Artificial Sequence
  Synthetic oligonucleotide
acccagtttccaccatgattaagggtc

SEQ ID NO: 6045 - DNA, 27 bp, Artificial Sequence
  Synthetic oligonucleotide
cccagtttccaccatgattaagggtct

SEQ ID NO: 6046 - DNA, 27 bp, Artificial Sequence
  Synthetic oligonucleotide
ccagtttccaccatgattaagggtctt

SEQ ID NO: 6047 - DNA, 27 bp, Artificial Sequence
  Synthetic oligonucleotide
cagtttccaccatgattaagggtcttt

SEQ ID NO: 6048 - DNA, 27 bp, Artificial Sequence
  Synthetic oligonucleotide
agtttccaccatgattaagggtcttta

SEQ ID NO: 6049 - DNA, 27 bp, Artificial Sequence
  Synthetic oligonucleotide
gtttccaccatgattaagggtctttac

SEQ ID NO: 6050 - DNA, 27 bp, Artificial Sequence
  Synthetic oligonucleotide
tttccaccatgattaagggtctttacg

SEQ ID NO: 6051 - DNA, 27 bp, Artificial Sequence
  Synthetic oligonucleotide
ttccaccatgattaagggtctttacgg

SEQ ID NO: 6052 - DNA, 27 bp, Artificial Sequence
  Synthetic oligonucleotide
tccaccatgattaagggtctttacgga

SEQ ID NO: 6053 - DNA, 27 bp, Artificial Sequence
  Synthetic oligonucleotide
ccaccatgattaagggtctttacggaa

SEQ ID NO: 6054 - DNA, 27 bp, Artificial Sequence
  Synthetic oligonucleotide
caccatgattaagggtctttacggaat

SEQ ID NO: 6055 - DNA, 27 bp, Artificial Sequence
  Synthetic oligonucleotide
accatgattaagggtctttacggaata

SEQ ID NO: 6056 - DNA, 27 bp, Artificial Sequence
  Synthetic oligonucleotide
ccatgattaagggtctttacggaataa

SEQ ID NO: 6057 - DNA, 27 bp, Artificial Sequence
  Synthetic oligonucleotide
catgattaagggtctttacggaataaa

SEQ ID NO: 6058 - DNA, 27 bp, Artificial Sequence
  Synthetic oligonucleotide
atgattaagggtctttacggaataaag

SEQ ID NO: 6059 - DNA, 27 bp, Artificial Sequence
  Synthetic oligonucleotide
tgattaagggtctttacggaataaagg

SEQ ID NO: 6060 - DNA, 27 bp, Artificial Sequence
  Synthetic oligonucleotide
gattaagggtctttacggaataaagga

SEQ ID NO: 6061 - DNA, 27 bp, Artificial Sequence
  Synthetic oligonucleotide
attaagggtctttacggaataaaggat

SEQ ID NO: 6062 - DNA, 27 bp, Artificial Sequence
  Synthetic oligonucleotide
ttaagggtctttacggaataaaggatg

SEQ ID NO: 6063 - DNA, 27 bp, Artificial Sequence
  Synthetic oligonucleotide
taagggtctttacggaataaaggatga

SEQ ID NO: 6064 - DNA, 27 bp, Artificial Sequence
  Synthetic oligonucleotide
aagggtctttacggaataaaggatgat

SEQ ID NO: 6065 - DNA, 27 bp, Artificial Sequence
  Synthetic oligonucleotide
agggtctttacggaataaaggatgatg

SEQ ID NO: 6066 - DNA, 27 bp, Artificial Sequence
  Synthetic oligonucleotide
gggtctttacggaataaaggatgatgt

SEQ ID NO: 6067 - DNA, 27 bp, Artificial Sequence
  Synthetic oligonucleotide
ggtctttacggaataaaggatgatgtc

SEQ ID NO: 6068 - DNA, 27 bp, Artificial Sequence
  Synthetic oligonucleotide
gtctttacggaataaaggatgatgtct

SEQ ID NO: 6069 - DNA, 27 bp, Artificial Sequence
  Synthetic oligonucleotide
tctttacggaataaaggatgatgtctt

SEQ ID NO: 6070 - DNA, 27 bp, Artificial Sequence
  Synthetic oligonucleotide
ctttacggaataaaggatgatgtcttc

SEQ ID NO: 6071 - DNA, 27 bp, Artificial Sequence
  Synthetic oligonucleotide
tttacggaataaaggatgatgtcttcc

SEQ ID NO: 6072 - DNA, 27 bp, Artificial Sequence
  Synthetic oligonucleotide
ttacggaataaaggatgatgtcttcct

SEQ ID NO: 6073 - DNA, 27 bp, Artificial Sequence
  Synthetic oligonucleotide
tacggaataaaggatgatgtcttcctt

SEQ ID NO: 6074 - DNA, 27 bp, Artificial Sequence
  Synthetic oligonucleotide
acggaataaaggatgatgtcttcctta

SEQ ID NO: 6075 - DNA, 27 bp, Artificial Sequence
  Synthetic oligonucleotide
cggaataaaggatgatgtcttccttag

SEQ ID NO: 6076 - DNA, 27 bp, Artificial Sequence
  Synthetic oligonucleotide
ggaataaaggatgatgtcttccttagt

SEQ ID NO: 6077 - DNA, 27 bp, Artificial Sequence
  Synthetic oligonucleotide
gaataaaggatgatgtcttccttagtg

SEQ ID NO: 6078 - DNA, 27 bp, Artificial Sequence
  Synthetic oligonucleotide
aataaaggatgatgtcttccttagtgt

SEQ ID NO: 6079 - DNA, 27 bp, Artificial Sequence
  Synthetic oligonucleotide
ataaaggatgatgtcttccttagtgtt

SEQ ID NO: 6080 - DNA, 27 bp, Artificial Sequence
  Synthetic oligonucleotide
taaaggatgatgtcttccttagtgttc

SEQ ID NO: 6081 - DNA, 27 bp, Artificial Sequence
  Synthetic oligonucleotide
aaaggatgatgtcttccttagtgttcc

SEQ ID NO: 6082 - DNA, 27 bp, Artificial Sequence
  Synthetic oligonucleotide
aaggatgatgtcttccttagtgttcct

SEQ ID NO: 6083 - DNA, 27 bp, Artificial Sequence
  Synthetic oligonucleotide
aggatgatgtcttccttagtgttcctt

SEQ ID NO: 6084 - DNA, 27 bp, Artificial Sequence
  Synthetic oligonucleotide
ggatgatgtcttccttagtgttccttg

SEQ ID NO: 6085 - DNA, 27 bp, Artificial Sequence
  Synthetic oligonucleotide
gatgatgtcttccttagtgttccttgc

SEQ ID NO: 6086 - DNA, 27 bp, Artificial Sequence
  Synthetic oligonucleotide
atgatgtcttccttagtgttccttgca

SEQ ID NO: 6087 - DNA, 27 bp, Artificial Sequence
  Synthetic oligonucleotide
tgatgtcttccttagtgttccttgcat

SEQ ID NO: 6088 - DNA, 27 bp, Artificial Sequence
  Synthetic oligonucleotide
gatgtcttccttagtgttccttgcatt

SEQ ID NO: 6089 - DNA, 27 bp, Artificial Sequence
  Synthetic oligonucleotide
atgtcttccttagtgttccttgcattt

SEQ ID NO: 6090 - DNA, 27 bp, Artificial Sequence
  Synthetic oligonucleotide
tgtcttccttagtgttccttgcatttt

SEQ ID NO: 6091 - DNA, 27 bp, Artificial Sequence
  Synthetic oligonucleotide
gtcttccttagtgttccttgcattttg

SEQ ID NO: 6092 - DNA, 27 bp, Artificial Sequence
  Synthetic oligonucleotide
tcttccttagtgttccttgcattttgg

SEQ ID NO: 6093 - DNA, 27 bp, Artificial Sequence
  Synthetic oligonucleotide
cttccttagtgttccttgcattttggg

SEQ ID NO: 6094 - DNA, 27 bp, Artificial Sequence
  Synthetic oligonucleotide
ttccttagtgttccttgcattttggga

SEQ ID NO: 6095 - DNA, 27 bp, Artificial Sequence
  Synthetic oligonucleotide
tccttagtgttccttgcattttgggac

SEQ ID NO: 6096 - DNA, 27 bp, Artificial Sequence
  Synthetic oligonucleotide
ccttagtgttccttgcattttgggaca

SEQ ID NO: 6097 - DNA, 27 bp, Artificial Sequence
  Synthetic oligonucleotide
cttagtgttccttgcattttgggacag

SEQ ID NO: 6098 - DNA, 27 bp, Artificial Sequence
  Synthetic oligonucleotide
ttagtgttccttgcattttgggacaga

SEQ ID NO: 6099 - DNA, 27 bp, Artificial Sequence
  Synthetic oligonucleotide
tagtgttccttgcattttgggacagaa

SEQ ID NO: 6100 - DNA, 27 bp, Artificial Sequence
  Synthetic oligonucleotide
agtgttccttgcattttgggacagaat

SEQ ID NO: 6101 - DNA, 27 bp, Artificial Sequence
  Synthetic oligonucleotide
gtgttccttgcattttgggacagaatg

SEQ ID NO: 6102 - DNA, 27 bp, Artificial Sequence
  Synthetic oligonucleotide
tgttccttgcattttgggacagaatgg

SEQ ID NO: 6103 - DNA, 27 bp, Artificial Sequence
  Synthetic oligonucleotide
gttccttgcattttgggacagaatgga

SEQ ID NO: 6104 - DNA, 27 bp, Artificial Sequence
  Synthetic oligonucleotide
ttccttgcattttgggacagaatggaa

SEQ ID NO: 6105 - DNA, 27 bp, Artificial Sequence
  Synthetic oligonucleotide
tccttgcattttgggacagaatggaat

SEQ ID NO: 6106 - DNA, 27 bp, Artificial Sequence
  Synthetic oligonucleotide
ccttgcattttgggacagaatggaatc

SEQ ID NO: 6107 - DNA, 27 bp, Artificial Sequence
  Synthetic oligonucleotide
cttgcattttgggacagaatggaatct

SEQ ID NO: 6108 - DNA, 27 bp, Artificial Sequence
  Synthetic oligonucleotide
ttgcattttgggacagaatggaatctc

SEQ ID NO: 6109 - DNA, 27 bp, Artificial Sequence
  Synthetic oligonucleotide
tgcattttgggacagaatggaatctca

SEQ ID NO: 6110 - DNA, 27 bp, Artificial Sequence
  Synthetic oligonucleotide
gcattttgggacagaatggaatctcag

SEQ ID NO: 6111 - DNA, 27 bp, Artificial Sequence
  Synthetic oligonucleotide
cattttgggacagaatggaatctcaga

SEQ ID NO: 6112 - DNA, 27 bp, Artificial Sequence
  Synthetic oligonucleotide
attttgggacagaatggaatctcagac

SEQ ID NO: 6113 - DNA, 27 bp, Artificial Sequence
  Synthetic oligonucleotide
ttttgggacagaatggaatctcagacc

SEQ ID NO: 6114 - DNA, 27 bp, Artificial Sequence
  Synthetic oligonucleotide
tttgggacagaatggaatctcagacct

SEQ ID NO: 6115 - DNA, 27 bp, Artificial Sequence
  Synthetic oligonucleotide
ttgggacagaatggaatctcagacctt

SEQ ID NO: 6116 - DNA, 27 bp, Artificial Sequence
  Synthetic oligonucleotide
tgggacagaatggaatctcagaccttg

SEQ ID NO: 6117 - DNA, 27 bp, Artificial Sequence
  Synthetic oligonucleotide
gggacagaatggaatctcagaccttgt

SEQ ID NO: 6118 - DNA, 27 bp, Artificial Sequence
  Synthetic oligonucleotide
ggacagaatggaatctcagaccttgtg

SEQ ID NO: 6119 - DNA, 27 bp, Artificial Sequence
  Synthetic oligonucleotide
gacagaatggaatctcagaccttgtga

SEQ ID NO: 6120 - DNA, 27 bp, Artificial Sequence
  Synthetic oligonucleotide
acagaatggaatctcagaccttgtgaa

SEQ ID NO: 6121 - DNA, 27 bp, Artificial Sequence
  Synthetic oligonucleotide
cagaatggaatctcagaccttgtgaag

SEQ ID NO: 6122 - DNA, 27 bp, Artificial Sequence
  Synthetic oligonucleotide
agaatggaatctcagaccttgtgaagg

SEQ ID NO: 6123 - DNA, 27 bp, Artificial Sequence
  Synthetic oligonucleotide
gaatggaatctcagaccttgtgaaggt

SEQ ID NO: 6124 - DNA, 27 bp, Artificial Sequence
  Synthetic oligonucleotide
aatggaatctcagaccttgtgaaggtg

SEQ ID NO: 6125 - DNA, 27 bp, Artificial Sequence
  Synthetic oligonucleotide
atggaatctcagaccttgtgaaggtga

SEQ ID NO: 6126 - DNA, 27 bp, Artificial Sequence
  Synthetic oligonucleotide
tggaatctcagaccttgtgaaggtgac

SEQ ID NO: 6127 - DNA, 27 bp, Artificial Sequence
  Synthetic oligonucleotide
ggaatctcagaccttgtgaaggtgact

SEQ ID NO: 6128 - DNA, 27 bp, Artificial Sequence
  Synthetic oligonucleotide
gaatctcagaccttgtgaaggtgactc

SEQ ID NO: 6129 - DNA, 27 bp, Artificial Sequence
  Synthetic oligonucleotide
aatctcagaccttgtgaaggtgactct

SEQ ID NO: 6130 - DNA, 27 bp, Artificial Sequence
  Synthetic oligonucleotide
atctcagaccttgtgaaggtgactctg

SEQ ID NO: 6131 - DNA, 27 bp, Artificial Sequence
  Synthetic oligonucleotide
tctcagaccttgtgaaggtgactctga

SEQ ID NO: 6132 - DNA, 27 bp, Artificial Sequence
  Synthetic oligonucleotide
ctcagaccttgtgaaggtgactctgac

SEQ ID NO: 6133 - DNA, 27 bp, Artificial Sequence
  Synthetic oligonucleotide
tcagaccttgtgaaggtgactctgact

SEQ ID NO: 6134 - DNA, 27 bp, Artificial Sequence
  Synthetic oligonucleotide
cagaccttgtgaaggtgactctgactt

SEQ ID NO: 6135 - DNA, 27 bp, Artificial Sequence
  Synthetic oligonucleotide
agaccttgtgaaggtgactctgacttc

SEQ ID NO: 6136 - DNA, 27 bp, Artificial Sequence
  Synthetic oligonucleotide
gaccttgtgaaggtgactctgacttct

SEQ ID NO: 6137 - DNA, 27 bp, Artificial Sequence
  Synthetic oligonucleotide
accttgtgaaggtgactctgacttctg

SEQ ID NO: 6138 - DNA, 27 bp, Artificial Sequence
  Synthetic oligonucleotide
ccttgtgaaggtgactctgacttctga

SEQ ID NO: 6139 - DNA, 27 bp, Artificial Sequence
  Synthetic oligonucleotide
cttgtgaaggtgactctgacttctgag

SEQ ID NO: 6140 - DNA, 27 bp, Artificial Sequence
  Synthetic oligonucleotide
ttgtgaaggtgactctgacttctgagg

SEQ ID NO: 6141 - DNA, 27 bp, Artificial Sequence
  Synthetic oligonucleotide
tgtgaaggtgactctgacttctgagga

SEQ ID NO: 6142 - DNA, 27 bp, Artificial Sequence
  Synthetic oligonucleotide
gtgaaggtgactctgacttctgaggaa

SEQ ID NO: 6143 - DNA, 27 bp, Artificial Sequence
  Synthetic oligonucleotide
tgaaggtgactctgacttctgaggaag

SEQ ID NO: 6144 - DNA, 27 bp, Artificial Sequence
  Synthetic oligonucleotide
gaaggtgactctgacttctgaggaaga

SEQ ID NO: 6145 - DNA, 27 bp, Artificial Sequence
  Synthetic oligonucleotide
aaggtgactctgacttctgaggaagag

SEQ ID NO: 6146 - DNA, 27 bp, Artificial Sequence
  Synthetic oligonucleotide
aggtgactctgacttctgaggaagagg

SEQ ID NO: 6147 - DNA, 27 bp, Artificial Sequence
  Synthetic oligonucleotide
ggtgactctgacttctgaggaagaggc

SEQ ID NO: 6148 - DNA, 27 bp, Artificial Sequence
  Synthetic oligonucleotide
gtgactctgacttctgaggaagaggcc

SEQ ID NO: 6149 - DNA, 27 bp, Artificial Sequence
  Synthetic oligonucleotide
tgactctgacttctgaggaagaggccc

SEQ ID NO: 6150 - DNA, 27 bp, Artificial Sequence
  Synthetic oligonucleotide
gactctgacttctgaggaagaggcccg

SEQ ID NO: 6151 - DNA, 27 bp, Artificial Sequence
  Synthetic oligonucleotide
actctgacttctgaggaagaggcccgt

SEQ ID NO: 6152 - DNA, 27 bp, Artificial Sequence
  Synthetic oligonucleotide
ctctgacttctgaggaagaggcccgtt

SEQ ID NO: 6153 - DNA, 27 bp, Artificial Sequence
  Synthetic oligonucleotide
tctgacttctgaggaagaggcccgttt

SEQ ID NO: 6154 - DNA, 27 bp, Artificial Sequence
  Synthetic oligonucleotide
ctgacttctgaggaagaggcccgtttg

SEQ ID NO: 6155 - DNA, 27 bp, Artificial Sequence
  Synthetic oligonucleotide
tgacttctgaggaagaggcccgtttga

SEQ ID NO: 6156 - DNA, 27 bp, Artificial Sequence
  Synthetic oligonucleotide
gacttctgaggaagaggcccgtttgaa

SEQ ID NO: 6157 - DNA, 27 bp, Artificial Sequence
  Synthetic oligonucleotide
acttctgaggaagaggcccgtttgaag

SEQ ID NO: 6158 - DNA, 27 bp, Artificial Sequence
  Synthetic oligonucleotide
cttctgaggaagaggcccgtttgaaga

SEQ ID NO: 6159 - DNA, 27 bp, Artificial Sequence
  Synthetic oligonucleotide
ttctgaggaagaggcccgtttgaagaa

SEQ ID NO: 6160 - DNA, 27 bp, Artificial Sequence
  Synthetic oligonucleotide
tctgaggaagaggcccgtttgaagaag

SEQ ID NO: 6161 - DNA, 27 bp, Artificial Sequence
  Synthetic oligonucleotide
ctgaggaagaggcccgtttgaagaaga

SEQ ID NO: 6162 - DNA, 27 bp, Artificial Sequence
  Synthetic oligonucleotide
tgaggaagaggcccgtttgaagaagag

SEQ ID NO: 6163 - DNA, 27 bp, Artificial Sequence
  Synthetic oligonucleotide
gaggaagaggcccgtttgaagaagagt

SEQ ID NO: 6164 - DNA, 27 bp, Artificial Sequence
  Synthetic oligonucleotide
aggaagaggcccgtttgaagaagagtg

SEQ ID NO: 6165 - DNA, 27 bp, Artificial Sequence
  Synthetic oligonucleotide
ggaagaggcccgtttgaagaagagtgc

SEQ ID NO: 6166 - DNA, 27 bp, Artificial Sequence
  Synthetic oligonucleotide
gaagaggcccgtttgaagaagagtgca

SEQ ID NO: 6167 - DNA, 27 bp, Artificial Sequence
  Synthetic oligonucleotide
aagaggcccgtttgaagaagagtgcag

SEQ ID NO: 6168 - DNA, 27 bp, Artificial Sequence
  Synthetic oligonucleotide
agaggcccgtttgaagaagagtgcaga

SEQ ID NO: 6169 - DNA, 27 bp, Artificial Sequence
  Synthetic oligonucleotide
gaggcccgtttgaagaagagtgcagat

SEQ ID NO: 6170 - DNA, 27 bp, Artificial Sequence
  Synthetic oligonucleotide
aggcccgtttgaagaagagtgcagata

SEQ ID NO: 6171 - DNA, 27 bp, Artificial Sequence
  Synthetic oligonucleotide
ggcccgtttgaagaagagtgcagatac

SEQ ID NO: 6172 - DNA, 27 bp, Artificial Sequence
  Synthetic oligonucleotide
gcccgtttgaagaagagtgcagataca

SEQ ID NO: 6173 - DNA, 27 bp, Artificial Sequence
  Synthetic oligonucleotide
cccgtttgaagaagagtgcagatacac

SEQ ID NO: 6174 - DNA, 27 bp, Artificial Sequence
  Synthetic oligonucleotide
ccgtttgaagaagagtgcagatacact

SEQ ID NO: 6175 - DNA, 27 bp, Artificial Sequence
  Synthetic oligonucleotide
cgtttgaagaagagtgcagatacactt

SEQ ID NO: 6176 - DNA, 27 bp, Artificial Sequence
  Synthetic oligonucleotide
gtttgaagaagagtgcagatacacttt

SEQ ID NO: 6177 - DNA, 27 bp, Artificial Sequence
  Synthetic oligonucleotide
tttgaagaagagtgcagatacactttg

SEQ ID NO: 6178 - DNA, 27 bp, Artificial Sequence
  Synthetic oligonucleotide
ttgaagaagagtgcagatacactttgg

SEQ ID NO: 6179 - DNA, 27 bp, Artificial Sequence
  Synthetic oligonucleotide
tgaagaagagtgcagatacactttggg

SEQ ID NO: 6180 - DNA, 27 bp, Artificial Sequence
  Synthetic oligonucleotide
gaagaagagtgcagatacactttgggg

SEQ ID NO: 6181 - DNA, 27 bp, Artificial Sequence
  Synthetic oligonucleotide
aagaagagtgcagatacactttggggg

SEQ ID NO: 6182 - DNA, 27 bp, Artificial Sequence
  Synthetic oligonucleotide
agaagagtgcagatacactttggggga

SEQ ID NO: 6183 - DNA, 27 bp, Artificial Sequence
  Synthetic oligonucleotide
gaagagtgcagatacactttgggggat

SEQ ID NO: 6184 - DNA, 27 bp, Artificial Sequence
  Synthetic oligonucleotide
aagagtgcagatacactttgggggatc

SEQ ID NO: 6185 - DNA, 27 bp, Artificial Sequence
  Synthetic oligonucleotide
agagtgcagatacactttgggggatcc

SEQ ID NO: 6186 - DNA, 27 bp, Artificial Sequence
  Synthetic oligonucleotide
gagtgcagatacactttgggggatcca

SEQ ID NO: 6187 - DNA, 27 bp, Artificial Sequence
  Synthetic oligonucleotide
agtgcagatacactttgggggatccaa

SEQ ID NO: 6188 - DNA, 27 bp, Artificial Sequence
  Synthetic oligonucleotide
gtgcagatacactttgggggatccaaa

SEQ ID NO: 6189 - DNA, 27 bp, Artificial Sequence
  Synthetic oligonucleotide
tgcagatacactttgggggatccaaaa

SEQ ID NO: 6190 - DNA, 27 bp, Artificial Sequence
  Synthetic oligonucleotide
gcagatacactttgggggatccaaaag

SEQ ID NO: 6191 - DNA, 27 bp, Artificial Sequence
  Synthetic oligonucleotide
cagatacactttgggggatccaaaagg

SEQ ID NO: 6192 - DNA, 27 bp, Artificial Sequence
  Synthetic oligonucleotide
agatacactttgggggatccaaaagga

SEQ ID NO: 6193 - DNA, 27 bp, Artificial Sequence
  Synthetic oligonucleotide
gatacactttgggggatccaaaaggag

SEQ ID NO: 6194 - DNA, 27 bp, Artificial Sequence
  Synthetic oligonucleotide
atacactttgggggatccaaaaggagc

SEQ ID NO: 6195 - DNA, 27 bp, Artificial Sequence
  Synthetic oligonucleotide
tacactttgggggatccaaaaggagct

SEQ ID NO: 6196 - DNA, 27 bp, Artificial Sequence
  Synthetic oligonucleotide
acactttgggggatccaaaaggagctg

SEQ ID NO: 6197 - DNA, 27 bp, Artificial Sequence
  Synthetic oligonucleotide
cactttgggggatccaaaaggagctgc

SEQ ID NO: 6198 - DNA, 27 bp, Artificial Sequence
  Synthetic oligonucleotide
actttgggggatccaaaaggagctgca

SEQ ID NO: 6199 - DNA, 27 bp, Artificial Sequence
  Synthetic oligonucleotide
ctttgggggatccaaaaggagctgcaa

SEQ ID NO: 6200 - DNA, 27 bp, Artificial Sequence
  Synthetic oligonucleotide
tttgggggatccaaaaggagctgcaat

SEQ ID NO: 6201 - DNA, 27 bp, Artificial Sequence
  Synthetic oligonucleotide
ttgggggatccaaaaggagctgcaatt

SEQ ID NO: 6202 - DNA, 27 bp, Artificial Sequence
  Synthetic oligonucleotide
tgggggatccaaaaggagctgcaattt

SEQ ID NO: 6203 - DNA, 27 bp, Artificial Sequence
  Synthetic oligonucleotide
gggggatccaaaaggagctgcaatttt

SEQ ID NO: 6204 - DNA, 27 bp, Artificial Sequence
  Synthetic oligonucleotide
ggggatccaaaaggagctgcaatttta

SEQ ID NO: 6205 - DNA, 27 bp, Artificial Sequence
  Synthetic oligonucleotide
gggatccaaaaggagctgcaattttaa

SEQ ID NO: 6206 - DNA, 27 bp, Artificial Sequence
  Synthetic oligonucleotide
ggatccaaaaggagctgcaattttaaa

SEQ ID NO: 6207 - DNA, 27 bp, Artificial Sequence
  Synthetic oligonucleotide
gatccaaaaggagctgcaattttaaag

SEQ ID NO: 6208 - DNA, 27 bp, Artificial Sequence
  Synthetic oligonucleotide
atccaaaaggagctgcaattttaaagt

SEQ ID NO: 6209 - DNA, 27 bp, Artificial Sequence
  Synthetic oligonucleotide
tccaaaaggagctgcaattttaaagtc

SEQ ID NO: 6210 - DNA, 27 bp, Artificial Sequence
  Synthetic oligonucleotide
ccaaaaggagctgcaattttaaagtct

SEQ ID NO: 6211 - DNA, 27 bp, Artificial Sequence
  Synthetic oligonucleotide
caaaaggagctgcaattttaaagtctt

SEQ ID NO: 6212 - DNA, 27 bp, Artificial Sequence
  Synthetic oligonucleotide
aaaaggagctgcaattttaaagtcttc

SEQ ID NO: 6213 - DNA, 27 bp, Artificial Sequence
  Synthetic oligonucleotide
aaaggagctgcaattttaaagtcttct

SEQ ID NO: 6214 - DNA, 27 bp, Artificial Sequence
  Synthetic oligonucleotide
aaggagctgcaattttaaagtcttctg

SEQ ID NO: 6215 - DNA, 27 bp, Artificial Sequence
  Synthetic oligonucleotide
aggagctgcaattttaaagtcttctga

SEQ ID NO: 6216 - DNA, 27 bp, Artificial Sequence
  Synthetic oligonucleotide
ggagctgcaattttaaagtcttctgat

SEQ ID NO: 6217 - DNA, 27 bp, Artificial Sequence
  Synthetic oligonucleotide
gagctgcaattttaaagtcttctgatg

SEQ ID NO: 6218 - DNA, 27 bp, Artificial Sequence
  Synthetic oligonucleotide
agctgcaattttaaagtcttctgatgt

SEQ ID NO: 6219 - DNA, 27 bp, Artificial Sequence
  Synthetic oligonucleotide
gctgcaattttaaagtcttctgatgtc

SEQ ID NO: 6220 - DNA, 27 bp, Artificial Sequence
  Synthetic oligonucleotide
gcaattttaaagtcttctgatgtcata

SEQ ID NO: 6221 - DNA, 27 bp, Artificial Sequence
  Synthetic oligonucleotide
caattttaaagtcttctgatgtcatat

SEQ ID NO: 6222 - DNA, 27 bp, Artificial Sequence
  Synthetic oligonucleotide
aattttaaagtcttctgatgtcatatc

SEQ ID NO: 6223 - DNA, 27 bp, Artificial Sequence
  Synthetic oligonucleotide
attttaaagtcttctgatgtcatatca

SEQ ID NO: 6224 - DNA, 27 bp, Artificial Sequence
  Synthetic oligonucleotide
taaagtcttctgatgtcatatcatttc

SEQ ID NO: 6225 - DNA, 27 bp, Artificial Sequence
  Synthetic oligonucleotide
aaagtcttctgatgtcatatcatttca

SEQ ID NO: 6226 - DNA, 27 bp, Artificial Sequence
  Synthetic oligonucleotide
aagtcttctgatgtcatatcatttcac

SEQ ID NO: 6227 - DNA, 27 bp, Artificial Sequence
  Synthetic oligonucleotide
agtcttctgatgtcatatcatttcact

SEQ ID NO: 6228 - DNA, 27 bp, Artificial Sequence
  Synthetic oligonucleotide
gtcttctgatgtcatatcatttcactg

SEQ ID NO: 6229 - DNA, 27 bp, Artificial Sequence
  Synthetic oligonucleotide
tcttctgatgtcatatcatttcactgt

SEQ ID NO: 6230 - DNA, 27 bp, Artificial Sequence
  Synthetic oligonucleotide
cttctgatgtcatatcatttcactgtc

SEQ ID NO: 6231 - DNA, 27 bp, Artificial Sequence
  Synthetic oligonucleotide
ttctgatgtcatatcatttcactgtct

SEQ ID NO: 6232 - DNA, 27 bp, Artificial Sequence
  Synthetic oligonucleotide
tctgatgtcatatcatttcactgtcta

SEQ ID NO: 6233 - DNA, 27 bp, Artificial Sequence
  Synthetic oligonucleotide
ctgatgtcatatcatttcactgtctag

SEQ ID NO: 6234 - DNA, 27 bp, Artificial Sequence
  Synthetic oligonucleotide
tgatgtcatatcatttcactgtctagg

SEQ ID NO: 6235 - DNA, 27 bp, Artificial Sequence
  Synthetic oligonucleotide
gatgtcatatcatttcactgtctaggc

SEQ ID NO: 6236 - DNA, 27 bp, Artificial Sequence
  Synthetic oligonucleotide
atgtcatatcatttcactgtctaggct

SEQ ID NO: 6237 - DNA, 27 bp, Artificial Sequence
  Synthetic oligonucleotide
tgtcatatcatttcactgtctaggcta

SEQ ID NO: 6238 - DNA, 27 bp, Artificial Sequence
  Synthetic oligonucleotide
gtcatatcatttcactgtctaggctac

SEQ ID NO: 6239 - DNA, 27 bp, Artificial Sequence
  Synthetic oligonucleotide
tcatatcatttcactgtctaggctaca

SEQ ID NO: 6240 - DNA, 27 bp, Artificial Sequence
  Synthetic oligonucleotide
catatcatttcactgtctaggctacaa

SEQ ID NO: 6241 - DNA, 27 bp, Artificial Sequence
  Synthetic oligonucleotide
atatcatttcactgtctaggctacaac

SEQ ID NO: 6242 - DNA, 27 bp, Artificial Sequence
  Synthetic oligonucleotide
tatcatttcactgtctaggctacaaca

SEQ ID NO: 6243 - DNA, 27 bp, Artificial Sequence
  Synthetic oligonucleotide
atcatttcactgtctaggctacaacag

SEQ ID NO: 6244 - DNA, 27 bp, Artificial Sequence
  Synthetic oligonucleotide
tcatttcactgtctaggctacaacagg

SEQ ID NO: 6245 - DNA, 27 bp, Artificial Sequence
  Synthetic oligonucleotide
catttcactgtctaggctacaacagga

SEQ ID NO: 6246 - DNA, 27 bp, Artificial Sequence
  Synthetic oligonucleotide
atttcactgtctaggctacaacaggat

SEQ ID NO: 6247 - DNA, 27 bp, Artificial Sequence
  Synthetic oligonucleotide
tttcactgtctaggctacaacaggatt

SEQ ID NO: 6248 - DNA, 27 bp, Artificial Sequence
  Synthetic oligonucleotide
ttcactgtctaggctacaacaggattc

SEQ ID NO: 6249 - DNA, 27 bp, Artificial Sequence
  Synthetic oligonucleotide
tcactgtctaggctacaacaggattct

SEQ ID NO: 6250 - DNA, 27 bp, Artificial Sequence
  Synthetic oligonucleotide
cactgtctaggctacaacaggattcta

SEQ ID NO: 6251 - DNA, 27 bp, Artificial Sequence
  Synthetic oligonucleotide
actgtctaggctacaacaggattctag

SEQ ID NO: 6252 - DNA, 27 bp, Artificial Sequence
  Synthetic oligonucleotide
ctgtctaggctacaacaggattctagg

SEQ ID NO: 6253 - DNA, 27 bp, Artificial Sequence
  Synthetic oligonucleotide
tgtctaggctacaacaggattctaggt

SEQ ID NO: 6254 - DNA, 27 bp, Artificial Sequence
  Synthetic oligonucleotide
gtctaggctacaacaggattctaggtg

SEQ ID NO: 6255 - DNA, 27 bp, Artificial Sequence
  Synthetic oligonucleotide
tctaggctacaacaggattctaggtgg

SEQ ID NO: 6256 - DNA, 27 bp, Artificial Sequence
  Synthetic oligonucleotide
ctaggctacaacaggattctaggtgga

SEQ ID NO: 6257 - DNA, 27 bp, Artificial Sequence
  Synthetic oligonucleotide
taggctacaacaggattctaggtggag

SEQ ID NO: 6258 - DNA, 27 bp, Artificial Sequence
  Synthetic oligonucleotide
aggctacaacaggattctaggtggagg

SEQ ID NO: 6259 - DNA, 27 bp, Artificial Sequence
  Synthetic oligonucleotide
ggctacaacaggattctaggtggaggt

SEQ ID NO: 6260 - DNA, 27 bp, Artificial Sequence
  Synthetic oligonucleotide
gctacaacaggattctaggtggaggtt

SEQ ID NO: 6261 - DNA, 27 bp, Artificial Sequence
  Synthetic oligonucleotide
ctacaacaggattctaggtggaggttg

SEQ ID NO: 6262 - DNA, 27 bp, Artificial Sequence
  Synthetic oligonucleotide
tacaacaggattctaggtggaggttgt

SEQ ID NO: 6263 - DNA, 27 bp, Artificial Sequence
  Synthetic oligonucleotide
acaacaggattctaggtggaggttgtg

SEQ ID NO: 6264 - DNA, 27 bp, Artificial Sequence
  Synthetic oligonucleotide
caacaggattctaggtggaggttgtgc

SEQ ID NO: 6265 - DNA, 27 bp, Artificial Sequence
  Synthetic oligonucleotide
aacaggattctaggtggaggttgtgca

SEQ ID NO: 6266 - DNA, 27 bp, Artificial Sequence
  Synthetic oligonucleotide
acaggattctaggtggaggttgtgcat

SEQ ID NO: 6267 - DNA, 27 bp, Artificial Sequence
  Synthetic oligonucleotide
caggattctaggtggaggttgtgcatg

SEQ ID NO: 6268 - DNA, 27 bp, Artificial Sequence
  Synthetic oligonucleotide
aggattctaggtggaggttgtgcatgt

SEQ ID NO: 6269 - DNA, 27 bp, Artificial Sequence
  Synthetic oligonucleotide
ggattctaggtggaggttgtgcatgtt

SEQ ID NO: 6270 - DNA, 27 bp, Artificial Sequence
  Synthetic oligonucleotide
gattctaggtggaggttgtgcatgttg

SEQ ID NO: 6271 - DNA, 27 bp, Artificial Sequence
  Synthetic oligonucleotide
attctaggtggaggttgtgcatgttgt

SEQ ID NO: 6272 - DNA, 27 bp, Artificial Sequence
  Synthetic oligonucleotide
ttctaggtggaggttgtgcatgttgtc

SEQ ID NO: 6273 - DNA, 27 bp, Artificial Sequence
  Synthetic oligonucleotide
tctaggtggaggttgtgcatgttgtcc

SEQ ID NO: 6274 - DNA, 27 bp, Artificial Sequence
  Synthetic oligonucleotide
ctaggtggaggttgtgcatgttgtcct

SEQ ID NO: 6275 - DNA, 27 bp, Artificial Sequence
  Synthetic oligonucleotide
taggtggaggttgtgcatgttgtcctt

SEQ ID NO: 6276 - DNA, 27 bp, Artificial Sequence
  Synthetic oligonucleotide
aggtggaggttgtgcatgttgtccttt

SEQ ID NO: 6277 - DNA, 27 bp, Artificial Sequence
  Synthetic oligonucleotide
ggtggaggttgtgcatgttgtcctttt

SEQ ID NO: 6278 - DNA, 27 bp, Artificial Sequence
  Synthetic oligonucleotide
gtggaggttgtgcatgttgtccttttt

SEQ ID NO: 6279 - DNA, 27 bp, Artificial Sequence
  Synthetic oligonucleotide
tggaggttgtgcatgttgtccttttta

SEQ ID NO: 6280 - DNA, 27 bp, Artificial Sequence
  Synthetic oligonucleotide
ggaggttgtgcatgttgtcctttttat

SEQ ID NO: 6281 - DNA, 27 bp, Artificial Sequence
  Synthetic oligonucleotide
gaggttgtgcatgttgtcctttttatc

SEQ ID NO: 6282 - DNA, 27 bp, Artificial Sequence
  Synthetic oligonucleotide
aggttgtgcatgttgtcctttttatct

SEQ ID NO: 6283 - DNA, 27 bp, Artificial Sequence
  Synthetic oligonucleotide
ggttgtgcatgttgtcctttttatctg

SEQ ID NO: 6284 - DNA, 27 bp, Artificial Sequence
  Synthetic oligonucleotide
gttgtgcatgttgtcctttttatctga

SEQ ID NO: 6285 - DNA, 27 bp, Artificial Sequence
  Synthetic oligonucleotide
ttgtgcatgttgtcctttttatctgat

SEQ ID NO: 6286 - DNA, 27 bp, Artificial Sequence
  Synthetic oligonucleotide
tgtgcatgttgtcctttttatctgatc

SEQ ID NO: 6287 - DNA, 27 bp, Artificial Sequence
  Synthetic oligonucleotide
gtgcatgttgtcctttttatctgatct

SEQ ID NO: 6288 - DNA, 27 bp, Artificial Sequence
  Synthetic oligonucleotide
gttgtcctttttatctgatctgtgatt

SEQ ID NO: 6289 - DNA, 27 bp, Artificial Sequence
  Synthetic oligonucleotide
cctttttatctgatctgtgattaaagc

SEQ ID NO: 6290 - DNA, 27 bp, Artificial Sequence
  Synthetic oligonucleotide
tttatctgatctgtgattaaagcagta

SEQ ID NO: 6291 - DNA, 27 bp, Artificial Sequence
  Synthetic oligonucleotide
ttatctgatctgtgattaaagcagtaa

SEQ ID NO: 6292 - DNA, 27 bp, Artificial Sequence
  Synthetic oligonucleotide
tatctgatctgtgattaaagcagtaat

SEQ ID NO: 6293 - DNA, 27 bp, Artificial Sequence
  Synthetic oligonucleotide
atctgatctgtgattaaagcagtaata

SEQ ID NO: 6294 - DNA, 27 bp, Artificial Sequence
  Synthetic oligonucleotide
tctgatctgtgattaaagcagtaatat

SEQ ID NO: 6295 - DNA, 27 bp, Artificial Sequence
  Synthetic oligonucleotide
ctgatctgtgattaaagcagtaatatt

SEQ ID NO: 6296 - DNA, 27 bp, Artificial Sequence
  Synthetic oligonucleotide
tgatctgtgattaaagcagtaatattt

SEQ ID NO: 6297 - DNA, 27 bp, Artificial Sequence
  Synthetic oligonucleotide
gatctgtgattaaagcagtaatatttt

SEQ ID NO: 6298 - DNA, 27 bp, Artificial Sequence
  Synthetic oligonucleotide
atctgtgattaaagcagtaatatttta

SEQ ID NO: 6299 - DNA, 27 bp, Artificial Sequence
  Synthetic oligonucleotide
tctgtgattaaagcagtaatattttaa

SEQ ID NO: 6300 - DNA, 27 bp, Artificial Sequence
  Synthetic oligonucleotide
ctgtgattaaagcagtaatattttaag

SEQ ID NO: 6301 - DNA, 27 bp, Artificial Sequence
  Synthetic oligonucleotide
tgtgattaaagcagtaatattttaaga

SEQ ID NO: 6302 - DNA, 27 bp, Artificial Sequence
  Synthetic oligonucleotide
gtgattaaagcagtaatattttaagat

SEQ ID NO: 6303 - DNA, 27 bp, Artificial Sequence
  Synthetic oligonucleotide
tgattaaagcagtaatattttaagatg

SEQ ID NO: 6304 - DNA, 27 bp, Artificial Sequence
  Synthetic oligonucleotide
gattaaagcagtaatattttaagatgg

SEQ ID NO: 6305 - DNA, 27 bp, Artificial Sequence
  Synthetic oligonucleotide
attaaagcagtaatattttaagatgga

SEQ ID NO: 6306 - DNA, 27 bp, Artificial Sequence
  Synthetic oligonucleotide
ttaaagcagtaatattttaagatggac

SEQ ID NO: 6307 - DNA, 27 bp, Artificial Sequence
  Synthetic oligonucleotide
taaagcagtaatattttaagatggact

SEQ ID NO: 6308 - DNA, 27 bp, Artificial Sequence
  Synthetic oligonucleotide
aaagcagtaatattttaagatggactg

SEQ ID NO: 6309 - DNA, 27 bp, Artificial Sequence
  Synthetic oligonucleotide
aagcagtaatattttaagatggactgg

SEQ ID NO: 6310 - DNA, 27 bp, Artificial Sequence
  Synthetic oligonucleotide
gcagtaatattttaagatggactggga

SEQ ID NO: 6311 - DNA, 27 bp, Artificial Sequence
  Synthetic oligonucleotide
cagtaatattttaagatggactgggaa

SEQ ID NO: 6312 - DNA, 27 bp, Artificial Sequence
  Synthetic oligonucleotide
agtaatattttaagatggactgggaaa

SEQ ID NO: 6313 - DNA, 27 bp, Artificial Sequence
  Synthetic oligonucleotide
gtaatattttaagatggactgggaaaa

SEQ ID NO: 6314 - DNA, 27 bp, Artificial Sequence
  Synthetic oligonucleotide
taatattttaagatggactgggaaaaa

SEQ ID NO: 6315 - DNA, 27 bp, Artificial Sequence
  Synthetic oligonucleotide
aatattttaagatggactgggaaaaac

SEQ ID NO: 6316 - DNA, 27 bp, Artificial Sequence
  Synthetic oligonucleotide
atattttaagatggactgggaaaaaca

SEQ ID NO: 6317 - DNA, 27 bp, Artificial Sequence
  Synthetic oligonucleotide
tattttaagatggactgggaaaaacat

SEQ ID NO: 6318 - DNA, 27 bp, Artificial Sequence
  Synthetic oligonucleotide
attttaagatggactgggaaaaacatc

SEQ ID NO: 6319 - DNA, 27 bp, Artificial Sequence
  Synthetic oligonucleotide
ttttaagatggactgggaaaaacatca

SEQ ID NO: 6320 - DNA, 27 bp, Artificial Sequence
  Synthetic oligonucleotide
tttaagatggactgggaaaaacatcaa

SEQ ID NO: 6321 - DNA, 27 bp, Artificial Sequence
  Synthetic oligonucleotide
ttaagatggactgggaaaaacatcaac

SEQ ID NO: 6322 - DNA, 27 bp, Artificial Sequence
  Synthetic oligonucleotide
taagatggactgggaaaaacatcaact

SEQ ID NO: 6323 - DNA, 27 bp, Artificial Sequence
  Synthetic oligonucleotide
aagatggactgggaaaaacatcaactc

SEQ ID NO: 6324 - DNA, 27 bp, Artificial Sequence
  Synthetic oligonucleotide
agatggactgggaaaaacatcaactcc

SEQ ID NO: 6325 - DNA, 27 bp, Artificial Sequence
  Synthetic oligonucleotide
gatggactgggaaaaacatcaactcct

SEQ ID NO: 6326 - DNA, 27 bp, Artificial Sequence
  Synthetic oligonucleotide
atggactgggaaaaacatcaactcctg

SEQ ID NO: 6327 - DNA, 27 bp, Artificial Sequence
  Synthetic oligonucleotide
tggactgggaaaaacatcaactcctga

SEQ ID NO: 6328 - DNA, 27 bp, Artificial Sequence
  Synthetic oligonucleotide
ggactgggaaaaacatcaactcctgaa

SEQ ID NO: 6329 - DNA, 27 bp, Artificial Sequence
  Synthetic oligonucleotide
gactgggaaaaacatcaactcctgaag

SEQ ID NO: 6330 - DNA, 27 bp, Artificial Sequence
  Synthetic oligonucleotide
actgggaaaaacatcaactcctgaagt

SEQ ID NO: 6331 - DNA, 27 bp, Artificial Sequence
  Synthetic oligonucleotide
ctgggaaaaacatcaactcctgaagtt

SEQ ID NO: 6332 - DNA, 27 bp, Artificial Sequence
  Synthetic oligonucleotide
tgggaaaaacatcaactcctgaagtta

SEQ ID NO: 6333 - DNA, 27 bp, Artificial Sequence
  Synthetic oligonucleotide
gggaaaaacatcaactcctgaagttag

SEQ ID NO: 6334 - DNA, 27 bp, Artificial Sequence
  Synthetic oligonucleotide
ggaaaaacatcaactcctgaagttaga

SEQ ID NO: 6335 - DNA, 27 bp, Artificial Sequence
  Synthetic oligonucleotide
gaaaaacatcaactcctgaagttagaa

SEQ ID NO: 6336 - DNA, 27 bp, Artificial Sequence
  Synthetic oligonucleotide
aaaaacatcaactcctgaagttagaaa

SEQ ID NO: 6337 - DNA, 27 bp, Artificial Sequence
  Synthetic oligonucleotide
aaaacatcaactcctgaagttagaaat

SEQ ID NO: 6338 - DNA, 27 bp, Artificial Sequence
  Synthetic oligonucleotide
aaacatcaactcctgaagttagaaata

SEQ ID NO: 6339 - DNA, 27 bp, Artificial Sequence
  Synthetic oligonucleotide
aacatcaactcctgaagttagaaataa

SEQ ID NO: 6340 - DNA, 27 bp, Artificial Sequence
  Synthetic oligonucleotide
acatcaactcctgaagttagaaataag

SEQ ID NO: 6341 - DNA, 27 bp, Artificial Sequence
  Synthetic oligonucleotide
catcaactcctgaagttagaaataaga

SEQ ID NO: 6342 - DNA, 27 bp, Artificial Sequence
  Synthetic oligonucleotide
atcaactcctgaagttagaaataagaa

SEQ ID NO: 6343 - DNA, 27 bp, Artificial Sequence
  Synthetic oligonucleotide
aactcctgaagttagaaataagaatgg

SEQ ID NO: 6344 - DNA, 27 bp, Artificial Sequence
  Synthetic oligonucleotide
actcctgaagttagaaataagaatggt

SEQ ID NO: 6345 - DNA, 27 bp, Artificial Sequence
  Synthetic oligonucleotide
ctcctgaagttagaaataagaatggtt

SEQ ID NO: 6346 - DNA, 27 bp, Artificial Sequence
  Synthetic oligonucleotide
tcctgaagttagaaataagaatggttt

SEQ ID NO: 6347 - DNA, 27 bp, Artificial Sequence
  Synthetic oligonucleotide
cctgaagttagaaataagaatggtttg

SEQ ID NO: 6348 - DNA, 27 bp, Artificial Sequence
  Synthetic oligonucleotide
ctgaagttagaaataagaatggtttgt

SEQ ID NO: 6349 - DNA, 27 bp, Artificial Sequence
  Synthetic oligonucleotide
tgaagttagaaataagaatggtttgta

SEQ ID NO: 6350 - DNA, 27 bp, Artificial Sequence
  Synthetic oligonucleotide
gaagttagaaataagaatggtttgtaa

SEQ ID NO: 6351 - DNA, 27 bp, Artificial Sequence
  Synthetic oligonucleotide
aagttagaaataagaatggtttgtaaa

SEQ ID NO: 6352 - DNA, 27 bp, Artificial Sequence
  Synthetic oligonucleotide
agttagaaataagaatggtttgtaaaa

SEQ ID NO: 6353 - DNA, 27 bp, Artificial Sequence
  Synthetic oligonucleotide
gttagaaataagaatggtttgtaaaat

SEQ ID NO: 6354 - DNA, 27 bp, Artificial Sequence
  Synthetic oligonucleotide
ttagaaataagaatggtttgtaaaatc

SEQ ID NO: 6355 - DNA, 27 bp, Artificial Sequence
  Synthetic oligonucleotide
tagaaataagaatggtttgtaaaatcc

SEQ ID NO: 6356 - DNA, 27 bp, Artificial Sequence
  Synthetic oligonucleotide
agaaataagaatggtttgtaaaatcca

SEQ ID NO: 6357 - DNA, 27 bp, Artificial Sequence
  Synthetic oligonucleotide
gaaataagaatggtttgtaaaatccac

SEQ ID NO: 6358 - DNA, 27 bp, Artificial Sequence
  Synthetic oligonucleotide
aaataagaatggtttgtaaaatccaca

SEQ ID NO: 6359 - DNA, 27 bp, Artificial Sequence
  Synthetic oligonucleotide
aataagaatggtttgtaaaatccacag

SEQ ID NO: 6360 - DNA, 27 bp, Artificial Sequence
  Synthetic oligonucleotide
ataagaatggtttgtaaaatccacagc

SEQ ID NO: 6361 - DNA, 27 bp, Artificial Sequence
  Synthetic oligonucleotide
taagaatggtttgtaaaatccacagct

SEQ ID NO: 6362 - DNA, 27 bp, Artificial Sequence
  Synthetic oligonucleotide
aagaatggtttgtaaaatccacagcta

SEQ ID NO: 6363 - DNA, 27 bp, Artificial Sequence
  Synthetic oligonucleotide
agaatggtttgtaaaatccacagctat

SEQ ID NO: 6364 - DNA, 27 bp, Artificial Sequence
  Synthetic oligonucleotide
gaatggtttgtaaaatccacagctata

SEQ ID NO: 6365 - DNA, 27 bp, Artificial Sequence
  Synthetic oligonucleotide
aatggtttgtaaaatccacagctatat

SEQ ID NO: 6366 - DNA, 27 bp, Artificial Sequence
  Synthetic oligonucleotide
atggtttgtaaaatccacagctatatc

SEQ ID NO: 6367 - DNA, 27 bp, Artificial Sequence
  Synthetic oligonucleotide
tggtttgtaaaatccacagctatatcc

SEQ ID NO: 6368 - DNA, 27 bp, Artificial Sequence
  Synthetic oligonucleotide
ggtttgtaaaatccacagctatatcct

SEQ ID NO: 6369 - DNA, 27 bp, Artificial Sequence
  Synthetic oligonucleotide
gtttgtaaaatccacagctatatcctg

SEQ ID NO: 6370 - DNA, 27 bp, Artificial Sequence
  Synthetic oligonucleotide
tttgtaaaatccacagctatatcctga

SEQ ID NO: 6371 - DNA, 27 bp, Artificial Sequence
  Synthetic oligonucleotide
ttgtaaaatccacagctatatcctgat

SEQ ID NO: 6372 - DNA, 27 bp, Artificial Sequence
  Synthetic oligonucleotide
tgtaaaatccacagctatatcctgatg

SEQ ID NO: 6373 - DNA, 27 bp, Artificial Sequence
  Synthetic oligonucleotide
gtaaaatccacagctatatcctgatgc

SEQ ID NO: 6374 - DNA, 27 bp, Artificial Sequence
  Synthetic oligonucleotide
taaaatccacagctatatcctgatgct

SEQ ID NO: 6375 - DNA, 27 bp, Artificial Sequence
  Synthetic oligonucleotide
aaaatccacagctatatcctgatgctg

SEQ ID NO: 6376 - DNA, 27 bp, Artificial Sequence
  Synthetic oligonucleotide
aaatccacagctatatcctgatgctgg

SEQ ID NO: 6377 - DNA, 27 bp, Artificial Sequence
  Synthetic oligonucleotide
aatccacagctatatcctgatgctgga

SEQ ID NO: 6378 - DNA, 27 bp, Artificial Sequence
  Synthetic oligonucleotide
atccacagctatatcctgatgctggat

SEQ ID NO: 6379 - DNA, 27 bp, Artificial Sequence
  Synthetic oligonucleotide
tccacagctatatcctgatgctggatg

SEQ ID NO: 6380 - DNA, 27 bp, Artificial Sequence
  Synthetic oligonucleotide
ccacagctatatcctgatgctggatgg

SEQ ID NO: 6381 - DNA, 27 bp, Artificial Sequence
  Synthetic oligonucleotide
cacagctatatcctgatgctggatggt

SEQ ID NO: 6382 - DNA, 27 bp, Artificial Sequence
  Synthetic oligonucleotide
acagctatatcctgatgctggatggta

SEQ ID NO: 6383 - DNA, 27 bp, Artificial Sequence
  Synthetic oligonucleotide
cagctatatcctgatgctggatggtat

SEQ ID NO: 6384 - DNA, 27 bp, Artificial Sequence
  Synthetic oligonucleotide
agctatatcctgatgctggatggtatt

SEQ ID NO: 6385 - DNA, 27 bp, Artificial Sequence
  Synthetic oligonucleotide
gctatatcctgatgctggatggtatta

SEQ ID NO: 6386 - DNA, 27 bp, Artificial Sequence
  Synthetic oligonucleotide
ctatatcctgatgctggatggtattaa

SEQ ID NO: 6387 - DNA, 27 bp, Artificial Sequence
  Synthetic oligonucleotide
tatatcctgatgctggatggtattaat

SEQ ID NO: 6388 - DNA, 27 bp, Artificial Sequence
  Synthetic oligonucleotide
atatcctgatgctggatggtattaatc

SEQ ID NO: 6389 - DNA, 27 bp, Artificial Sequence
  Synthetic oligonucleotide
tatcctgatgctggatggtattaatct

SEQ ID NO: 6390 - DNA, 27 bp, Artificial Sequence
  Synthetic oligonucleotide
atcctgatgctggatggtattaatctt

SEQ ID NO: 6391 - DNA, 27 bp, Artificial Sequence
  Synthetic oligonucleotide
tcctgatgctggatggtattaatcttg

SEQ ID NO: 6392 - DNA, 27 bp, Artificial Sequence
  Synthetic oligonucleotide
cctgatgctggatggtattaatcttgt

SEQ ID NO: 6393 - DNA, 27 bp, Artificial Sequence
  Synthetic oligonucleotide
ctgatgctggatggtattaatcttgtg

SEQ ID NO: 6394 - DNA, 27 bp, Artificial Sequence
  Synthetic oligonucleotide
tgatgctggatggtattaatcttgtgt

SEQ ID NO: 6395 - DNA, 27 bp, Artificial Sequence
  Synthetic oligonucleotide
gatgctggatggtattaatcttgtgta

SEQ ID NO: 6396 - DNA, 27 bp, Artificial Sequence
  Synthetic oligonucleotide
atgctggatggtattaatcttgtgtag

SEQ ID NO: 6397 - DNA, 27 bp, Artificial Sequence
  Synthetic oligonucleotide
tgctggatggtattaatcttgtgtagt

SEQ ID NO: 6398 - DNA, 27 bp, Artificial Sequence
  Synthetic oligonucleotide
gctggatggtattaatcttgtgtagtc

SEQ ID NO: 6399 - DNA, 27 bp, Artificial Sequence
  Synthetic oligonucleotide
ctggatggtattaatcttgtgtagtct

SEQ ID NO: 6400 - DNA, 27 bp, Artificial Sequence
  Synthetic oligonucleotide
tggatggtattaatcttgtgtagtctt

SEQ ID NO: 6401 - DNA, 27 bp, Artificial Sequence
  Synthetic oligonucleotide
ggatggtattaatcttgtgtagtcttc

SEQ ID NO: 6402 - DNA, 27 bp, Artificial Sequence
  Synthetic oligonucleotide
gatggtattaatcttgtgtagtcttca

SEQ ID NO: 6403 - DNA, 27 bp, Artificial Sequence
  Synthetic oligonucleotide
atggtattaatcttgtgtagtcttcaa

SEQ ID NO: 6404 - DNA, 27 bp, Artificial Sequence
  Synthetic oligonucleotide
tggtattaatcttgtgtagtcttcaac

SEQ ID NO: 6405 - DNA, 27 bp, Artificial Sequence
  Synthetic oligonucleotide
ggtattaatcttgtgtagtcttcaact

SEQ ID NO: 6406 - DNA, 27 bp, Artificial Sequence
  Synthetic oligonucleotide
gtattaatcttgtgtagtcttcaactg

SEQ ID NO: 6407 - DNA, 27 bp, Artificial Sequence
  Synthetic oligonucleotide
tattaatcttgtgtagtcttcaactgg

SEQ ID NO: 6408 - DNA, 27 bp, Artificial Sequence
  Synthetic oligonucleotide
attaatcttgtgtagtcttcaactggt

SEQ ID NO: 6409 - DNA, 27 bp, Artificial Sequence
  Synthetic oligonucleotide
ttaatcttgtgtagtcttcaactggtt

SEQ ID NO: 6410 - DNA, 27 bp, Artificial Sequence
  Synthetic oligonucleotide
taatcttgtgtagtcttcaactggtta

SEQ ID NO: 6411 - DNA, 27 bp, Artificial Sequence
  Synthetic oligonucleotide
aatcttgtgtagtcttcaactggttag

SEQ ID NO: 6412 - DNA, 27 bp, Artificial Sequence
  Synthetic oligonucleotide
atcttgtgtagtcttcaactggttagt

SEQ ID NO: 6413 - DNA, 27 bp, Artificial Sequence
  Synthetic oligonucleotide
tcttgtgtagtcttcaactggttagtg

SEQ ID NO: 6414 - DNA, 27 bp, Artificial Sequence
  Synthetic oligonucleotide
cttgtgtagtcttcaactggttagtgt

SEQ ID NO: 6415 - DNA, 27 bp, Artificial Sequence
  Synthetic oligonucleotide
ttgtgtagtcttcaactggttagtgtg

SEQ ID NO: 6416 - DNA, 27 bp, Artificial Sequence
  Synthetic oligonucleotide
tgtgtagtcttcaactggttagtgtga

SEQ ID NO: 6417 - DNA, 27 bp, Artificial Sequence
  Synthetic oligonucleotide
gtgtagtcttcaactggttagtgtgaa

SEQ ID NO: 6418 - DNA, 27 bp, Artificial Sequence
  Synthetic oligonucleotide
tgtagtcttcaactggttagtgtgaaa

SEQ ID NO: 6419 - DNA, 27 bp, Artificial Sequence
  Synthetic oligonucleotide
gtagtcttcaactggttagtgtgaaat

SEQ ID NO: 6420 - DNA, 27 bp, Artificial Sequence
  Synthetic oligonucleotide
tagtcttcaactggttagtgtgaaata

SEQ ID NO: 6421 - DNA, 27 bp, Artificial Sequence
  Synthetic oligonucleotide
agtcttcaactggttagtgtgaaatag

SEQ ID NO: 6422 - DNA, 27 bp, Artificial Sequence
  Synthetic oligonucleotide
gtcttcaactggttagtgtgaaatagt

SEQ ID NO: 6423 - DNA, 27 bp, Artificial Sequence
  Synthetic oligonucleotide
tcttcaactggttagtgtgaaatagtt

SEQ ID NO: 6424 - DNA, 27 bp, Artificial Sequence
  Synthetic oligonucleotide
cttcaactggttagtgtgaaatagttc

SEQ ID NO: 6425 - DNA, 27 bp, Artificial Sequence
  Synthetic oligonucleotide
ttcaactggttagtgtgaaatagttct

SEQ ID NO: 6426 - DNA, 27 bp, Artificial Sequence
  Synthetic oligonucleotide
actggttagtgtgaaatagttctgcca

SEQ ID NO: 6427 - DNA, 27 bp, Artificial Sequence
  Synthetic oligonucleotide
tggttagtgtgaaatagttctgccacc

SEQ ID NO: 6428 - DNA, 27 bp, Artificial Sequence
  Synthetic oligonucleotide
ggttagtgtgaaatagttctgccacct

SEQ ID NO: 6429 - DNA, 27 bp, Artificial Sequence
  Synthetic oligonucleotide
gttagtgtgaaatagttctgccacctc

SEQ ID NO: 6430 - DNA, 27 bp, Artificial Sequence
  Synthetic oligonucleotide
ttagtgtgaaatagttctgccacctct

SEQ ID NO: 6431 - DNA, 27 bp, Artificial Sequence
  Synthetic oligonucleotide
tagtgtgaaatagttctgccacctctg

SEQ ID NO: 6432 - DNA, 27 bp, Artificial Sequence
  Synthetic oligonucleotide
agtgtgaaatagttctgccacctctga

SEQ ID NO: 6433 - DNA, 27 bp, Artificial Sequence
  Synthetic oligonucleotide
gtgtgaaatagttctgccacctctgac

SEQ ID NO: 6434 - DNA, 27 bp, Artificial Sequence
  Synthetic oligonucleotide
tgtgaaatagttctgccacctctgacg

SEQ ID NO: 6435 - DNA, 27 bp, Artificial Sequence
  Synthetic oligonucleotide
gtgaaatagttctgccacctctgacgc

SEQ ID NO: 6436 - DNA, 27 bp, Artificial Sequence
  Synthetic oligonucleotide
tgaaatagttctgccacctctgacgca

SEQ ID NO: 6437 - DNA, 27 bp, Artificial Sequence
  Synthetic oligonucleotide
gaaatagttctgccacctctgacgcac

SEQ ID NO: 6438 - DNA, 27 bp, Artificial Sequence
  Synthetic oligonucleotide
aaatagttctgccacctctgacgcacc

SEQ ID NO: 6439 - DNA, 27 bp, Artificial Sequence
  Synthetic oligonucleotide
aatagttctgccacctctgacgcacca

SEQ ID NO: 6440 - DNA, 27 bp, Artificial Sequence
  Synthetic oligonucleotide
atagttctgccacctctgacgcaccac

SEQ ID NO: 6441 - DNA, 27 bp, Artificial Sequence
  Synthetic oligonucleotide
tagttctgccacctctgacgcaccact

SEQ ID NO: 6442 - DNA, 27 bp, Artificial Sequence
  Synthetic oligonucleotide
agttctgccacctctgacgcaccactg

SEQ ID NO: 6443 - DNA, 27 bp, Artificial Sequence
  Synthetic oligonucleotide
gttctgccacctctgacgcaccactgc

SEQ ID NO: 6444 - DNA, 27 bp, Artificial Sequence
  Synthetic oligonucleotide
ttctgccacctctgacgcaccactgcc

SEQ ID NO: 6445 - DNA, 27 bp, Artificial Sequence
  Synthetic oligonucleotide
tctgccacctctgacgcaccactgcca

SEQ ID NO: 6446 - DNA, 27 bp, Artificial Sequence
  Synthetic oligonucleotide
ctgccacctctgacgcaccactgccaa

SEQ ID NO: 6447 - DNA, 27 bp, Artificial Sequence
  Synthetic oligonucleotide
tgccacctctgacgcaccactgccaat

SEQ ID NO: 6448 - DNA, 27 bp, Artificial Sequence
  Synthetic oligonucleotide
gccacctctgacgcaccactgccaatg

SEQ ID NO: 6449 - DNA, 27 bp, Artificial Sequence
  Synthetic oligonucleotide
ccacctctgacgcaccactgccaatgc

SEQ ID NO: 6450 - DNA, 27 bp, Artificial Sequence
  Synthetic oligonucleotide
cacctctgacgcaccactgccaatgct

SEQ ID NO: 6451 - DNA, 27 bp, Artificial Sequence
  Synthetic oligonucleotide
acctctgacgcaccactgccaatgctg

SEQ ID NO: 6452 - DNA, 27 bp, Artificial Sequence
  Synthetic oligonucleotide
cctctgacgcaccactgccaatgctgt

SEQ ID NO: 6453 - DNA, 27 bp, Artificial Sequence
  Synthetic oligonucleotide
ctctgacgcaccactgccaatgctgta

SEQ ID NO: 6454 - DNA, 27 bp, Artificial Sequence
  Synthetic oligonucleotide
tctgacgcaccactgccaatgctgtac

SEQ ID NO: 6455 - DNA, 27 bp, Artificial Sequence
  Synthetic oligonucleotide
ctgacgcaccactgccaatgctgtacg

SEQ ID NO: 6456 - DNA, 27 bp, Artificial Sequence
  Synthetic oligonucleotide
tgacgcaccactgccaatgctgtacgt

SEQ ID NO: 6457 - DNA, 27 bp, Artificial Sequence
  Synthetic oligonucleotide
gacgcaccactgccaatgctgtacgta

SEQ ID NO: 6458 - DNA, 27 bp, Artificial Sequence
  Synthetic oligonucleotide
acgcaccactgccaatgctgtacgtac

SEQ ID NO: 6459 - DNA, 27 bp, Artificial Sequence
  Synthetic oligonucleotide
cgcaccactgccaatgctgtacgtact

SEQ ID NO: 6460 - DNA, 27 bp, Artificial Sequence
  Synthetic oligonucleotide
gcaccactgccaatgctgtacgtactg

SEQ ID NO: 6461 - DNA, 27 bp, Artificial Sequence
  Synthetic oligonucleotide
caccactgccaatgctgtacgtactgc

SEQ ID NO: 6462 - DNA, 27 bp, Artificial Sequence
  Synthetic oligonucleotide
accactgccaatgctgtacgtactgca

SEQ ID NO: 6463 - DNA, 27 bp, Artificial Sequence
  Synthetic oligonucleotide
ccactgccaatgctgtacgtactgcat

SEQ ID NO: 6464 - DNA, 27 bp, Artificial Sequence
  Synthetic oligonucleotide
cactgccaatgctgtacgtactgcatt

SEQ ID NO: 6465 - DNA, 27 bp, Artificial Sequence
  Synthetic oligonucleotide
actgccaatgctgtacgtactgcattt

SEQ ID NO: 6466 - DNA, 27 bp, Artificial Sequence
  Synthetic oligonucleotide
ctgccaatgctgtacgtactgcatttg

SEQ ID NO: 6467 - DNA, 27 bp, Artificial Sequence
  Synthetic oligonucleotide
tgccaatgctgtacgtactgcatttgc

SEQ ID NO: 6468 - DNA, 27 bp, Artificial Sequence
  Synthetic oligonucleotide
gccaatgctgtacgtactgcatttgcc

SEQ ID NO: 6469 - DNA, 27 bp, Artificial Sequence
  Synthetic oligonucleotide
ccaatgctgtacgtactgcatttgccc

SEQ ID NO: 6470 - DNA, 27 bp, Artificial Sequence
  Synthetic oligonucleotide
caatgctgtacgtactgcatttgcccc

SEQ ID NO: 6471 - DNA, 27 bp, Artificial Sequence
  Synthetic oligonucleotide
aatgctgtacgtactgcatttgcccct

SEQ ID NO: 6472 - DNA, 27 bp, Artificial Sequence
  Synthetic oligonucleotide
atgctgtacgtactgcatttgcccctt

SEQ ID NO: 6473 - DNA, 27 bp, Artificial Sequence
  Synthetic oligonucleotide
tgctgtacgtactgcatttgccccttg

SEQ ID NO: 6474 - DNA, 27 bp, Artificial Sequence
  Synthetic oligonucleotide
gctgtacgtactgcatttgccccttga

SEQ ID NO: 6475 - DNA, 27 bp, Artificial Sequence
  Synthetic oligonucleotide
ctgtacgtactgcatttgccccttgag

SEQ ID NO: 6476 - DNA, 27 bp, Artificial Sequence
  Synthetic oligonucleotide
tgtacgtactgcatttgccccttgagc

SEQ ID NO: 6477 - DNA, 27 bp, Artificial Sequence
  Synthetic oligonucleotide
gtacgtactgcatttgccccttgagcc

SEQ ID NO: 6478 - DNA, 27 bp, Artificial Sequence
  Synthetic oligonucleotide
tacgtactgcatttgccccttgagcca

SEQ ID NO: 6479 - DNA, 27 bp, Artificial Sequence
  Synthetic oligonucleotide
acgtactgcatttgccccttgagccag

SEQ ID NO: 6480 - DNA, 27 bp, Artificial Sequence
  Synthetic oligonucleotide
cgtactgcatttgccccttgagccagg

SEQ ID NO: 6481 - DNA, 27 bp, Artificial Sequence
  Synthetic oligonucleotide
gtactgcatttgccccttgagccaggt

SEQ ID NO: 6482 - DNA, 27 bp, Artificial Sequence
  Synthetic oligonucleotide
tactgcatttgccccttgagccaggtg

SEQ ID NO: 6483 - DNA, 27 bp, Artificial Sequence
  Synthetic oligonucleotide
actgcatttgccccttgagccaggtgg

SEQ ID NO: 6484 - DNA, 27 bp, Artificial Sequence
  Synthetic oligonucleotide
ctgcatttgccccttgagccaggtgga

SEQ ID NO: 6485 - DNA, 27 bp, Artificial Sequence
  Synthetic oligonucleotide
tgcatttgccccttgagccaggtggat

SEQ ID NO: 6486 - DNA, 27 bp, Artificial Sequence
  Synthetic oligonucleotide
gcatttgccccttgagccaggtggatg

SEQ ID NO: 6487 - DNA, 27 bp, Artificial Sequence
  Synthetic oligonucleotide
catttgccccttgagccaggtggatgt

SEQ ID NO: 6488 - DNA, 27 bp, Artificial Sequence
  Synthetic oligonucleotide
atttgccccttgagccaggtggatgtt

SEQ ID NO: 6489 - DNA, 27 bp, Artificial Sequence
  Synthetic oligonucleotide
tttgccccttgagccaggtggatgttt

SEQ ID NO: 6490 - DNA, 27 bp, Artificial Sequence
  Synthetic oligonucleotide
ttgccccttgagccaggtggatgttta

SEQ ID NO: 6491 - DNA, 27 bp, Artificial Sequence
  Synthetic oligonucleotide
tgccccttgagccaggtggatgtttac

SEQ ID NO: 6492 - DNA, 27 bp, Artificial Sequence
  Synthetic oligonucleotide
gccccttgagccaggtggatgtttacc

SEQ ID NO: 6493 - DNA, 27 bp, Artificial Sequence
  Synthetic oligonucleotide
ccccttgagccaggtggatgtttaccg

SEQ ID NO: 6494 - DNA, 27 bp, Artificial Sequence
  Synthetic oligonucleotide
cccttgagccaggtggatgtttaccgt

SEQ ID NO: 6495 - DNA, 27 bp, Artificial Sequence
  Synthetic oligonucleotide
ccttgagccaggtggatgtttaccgtg

SEQ ID NO: 6496 - DNA, 27 bp, Artificial Sequence
  Synthetic oligonucleotide
cttgagccaggtggatgtttaccgtgt

SEQ ID NO: 6497 - DNA, 27 bp, Artificial Sequence
  Synthetic oligonucleotide
ttgagccaggtggatgtttaccgtgtg

SEQ ID NO: 6498 - DNA, 27 bp, Artificial Sequence
  Synthetic oligonucleotide
tgagccaggtggatgtttaccgtgtgt

SEQ ID NO: 6499 - DNA, 27 bp, Artificial Sequence
  Synthetic oligonucleotide
gagccaggtggatgtttaccgtgtgtt

SEQ ID NO: 6500 - DNA, 27 bp, Artificial Sequence
  Synthetic oligonucleotide
agccaggtggatgtttaccgtgtgtta

SEQ ID NO: 6501 - DNA, 27 bp, Artificial Sequence
  Synthetic oligonucleotide
gccaggtggatgtttaccgtgtgttat

SEQ ID NO: 6502 - DNA, 27 bp, Artificial Sequence
  Synthetic oligonucleotide
ccaggtggatgtttaccgtgtgttata

SEQ ID NO: 6503 - DNA, 27 bp, Artificial Sequence
  Synthetic oligonucleotide
caggtggatgtttaccgtgtgttatat

SEQ ID NO: 6504 - DNA, 27 bp, Artificial Sequence
  Synthetic oligonucleotide
aggtggatgtttaccgtgtgttatata

SEQ ID NO: 6505 - DNA, 27 bp, Artificial Sequence
  Synthetic oligonucleotide
ggtggatgtttaccgtgtgttatataa

SEQ ID NO: 6506 - DNA, 27 bp, Artificial Sequence
  Synthetic oligonucleotide
gtggatgtttaccgtgtgttatataac

SEQ ID NO: 6507 - DNA, 27 bp, Artificial Sequence
  Synthetic oligonucleotide
tggatgtttaccgtgtgttatataact

SEQ ID NO: 6508 - DNA, 27 bp, Artificial Sequence
  Synthetic oligonucleotide
ggatgtttaccgtgtgttatataactt

SEQ ID NO: 6509 - DNA, 27 bp, Artificial Sequence
  Synthetic oligonucleotide
gatgtttaccgtgtgttatataacttc

SEQ ID NO: 6510 - DNA, 27 bp, Artificial Sequence
  Synthetic oligonucleotide
atgtttaccgtgtgttatataacttcc

SEQ ID NO: 6511 - DNA, 27 bp, Artificial Sequence
  Synthetic oligonucleotide
tgtttaccgtgtgttatataacttcct

SEQ ID NO: 6512 - DNA, 27 bp, Artificial Sequence
  Synthetic oligonucleotide
gtttaccgtgtgttatataacttcctg

SEQ ID NO: 6513 - DNA, 27 bp, Artificial Sequence
  Synthetic oligonucleotide
tttaccgtgtgttatataacttcctgg

SEQ ID NO: 6514 - DNA, 27 bp, Artificial Sequence
  Synthetic oligonucleotide
ttaccgtgtgttatataacttcctggc

SEQ ID NO: 6515 - DNA, 27 bp, Artificial Sequence
  Synthetic oligonucleotide
taccgtgtgttatataacttcctggct

SEQ ID NO: 6516 - DNA, 27 bp, Artificial Sequence
  Synthetic oligonucleotide
accgtgtgttatataacttcctggctc

SEQ ID NO: 6517 - DNA, 27 bp, Artificial Sequence
  Synthetic oligonucleotide
ccgtgtgttatataacttcctggctcc

SEQ ID NO: 6518 - DNA, 27 bp, Artificial Sequence
  Synthetic oligonucleotide
cgtgtgttatataacttcctggctcct

SEQ ID NO: 6519 - DNA, 27 bp, Artificial Sequence
  Synthetic oligonucleotide
gtgtgttatataacttcctggctcctt

SEQ ID NO: 6520 - DNA, 27 bp, Artificial Sequence
  Synthetic oligonucleotide
tgtgttatataacttcctggctccttc

SEQ ID NO: 6521 - DNA, 27 bp, Artificial Sequence
  Synthetic oligonucleotide
gtgttatataacttcctggctccttca

SEQ ID NO: 6522 - DNA, 27 bp, Artificial Sequence
  Synthetic oligonucleotide
tgttatataacttcctggctccttcac

SEQ ID NO: 6523 - DNA, 27 bp, Artificial Sequence
  Synthetic oligonucleotide
gttatataacttcctggctccttcact

SEQ ID NO: 6524 - DNA, 27 bp, Artificial Sequence
  Synthetic oligonucleotide
ttatataacttcctggctccttcactg

SEQ ID NO: 6525 - DNA, 27 bp, Artificial Sequence
  Synthetic oligonucleotide
tatataacttcctggctccttcactga

SEQ ID NO: 6526 - DNA, 27 bp, Artificial Sequence
  Synthetic oligonucleotide
atataacttcctggctccttcactgaa

SEQ ID NO: 6527 - DNA, 27 bp, Artificial Sequence
  Synthetic oligonucleotide
tataacttcctggctccttcactgaac

SEQ ID NO: 6528 - DNA, 27 bp, Artificial Sequence
  Synthetic oligonucleotide
ataacttcctggctccttcactgaaca

SEQ ID NO: 6529 - DNA, 27 bp, Artificial Sequence
  Synthetic oligonucleotide
taacttcctggctccttcactgaacat

SEQ ID NO: 6530 - DNA, 27 bp, Artificial Sequence
  Synthetic oligonucleotide
aacttcctggctccttcactgaacatg

SEQ ID NO: 6531 - DNA, 27 bp, Artificial Sequence
  Synthetic oligonucleotide
acttcctggctccttcactgaacatgc

SEQ ID NO: 6532 - DNA, 27 bp, Artificial Sequence
  Synthetic oligonucleotide
cttcctggctccttcactgaacatgcc

SEQ ID NO: 6533 - DNA, 27 bp, Artificial Sequence
  Synthetic oligonucleotide
ttcctggctccttcactgaacatgcct

SEQ ID NO: 6534 - DNA, 27 bp, Artificial Sequence
  Synthetic oligonucleotide
tcctggctccttcactgaacatgccta

SEQ ID NO: 6535 - DNA, 27 bp, Artificial Sequence
  Synthetic oligonucleotide
cctggctccttcactgaacatgcctag

SEQ ID NO: 6536 - DNA, 27 bp, Artificial Sequence
  Synthetic oligonucleotide
ctggctccttcactgaacatgcctagt

SEQ ID NO: 6537 - DNA, 27 bp, Artificial Sequence
  Synthetic oligonucleotide
tggctccttcactgaacatgcctagtc

SEQ ID NO: 6538 - DNA, 27 bp, Artificial Sequence
  Synthetic oligonucleotide
ggctccttcactgaacatgcctagtcc

SEQ ID NO: 6539 - DNA, 27 bp, Artificial Sequence
  Synthetic oligonucleotide
gctccttcactgaacatgcctagtcca

SEQ ID NO: 6540 - DNA, 27 bp, Artificial Sequence
  Synthetic oligonucleotide
ctccttcactgaacatgcctagtccaa

SEQ ID NO: 6541 - DNA, 27 bp, Artificial Sequence
  Synthetic oligonucleotide
tccttcactgaacatgcctagtccaac

SEQ ID NO: 6542 - DNA, 27 bp, Artificial Sequence
  Synthetic oligonucleotide
ccttcactgaacatgcctagtccaaca

SEQ ID NO: 6543 - DNA, 27 bp, Artificial Sequence
  Synthetic oligonucleotide
cttcactgaacatgcctagtccaacat

SEQ ID NO: 6544 - DNA, 27 bp, Artificial Sequence
  Synthetic oligonucleotide
ttcactgaacatgcctagtccaacatt

SEQ ID NO: 6545 - DNA, 27 bp, Artificial Sequence
  Synthetic oligonucleotide
tcactgaacatgcctagtccaacattt

SEQ ID NO: 6546 - DNA, 27 bp, Artificial Sequence
  Synthetic oligonucleotide
cactgaacatgcctagtccaacatttt

SEQ ID NO: 6547 - DNA, 27 bp, Artificial Sequence
  Synthetic oligonucleotide
actgaacatgcctagtccaacattttt

SEQ ID NO: 6548 - DNA, 27 bp, Artificial Sequence
  Synthetic oligonucleotide
ctgaacatgcctagtccaacatttttt

SEQ ID NO: 6549 - DNA, 27 bp, Artificial Sequence
  Synthetic oligonucleotide
tgaacatgcctagtccaacattttttc

SEQ ID NO: 6550 - DNA, 27 bp, Artificial Sequence
  Synthetic oligonucleotide
gaacatgcctagtccaacattttttcc

SEQ ID NO: 6551 - DNA, 27 bp, Artificial Sequence
  Synthetic oligonucleotide
aacatgcctagtccaacattttttccc

SEQ ID NO: 6552 - DNA, 27 bp, Artificial Sequence
  Synthetic oligonucleotide
acatgcctagtccaacattttttccca

SEQ ID NO: 6553 - DNA, 27 bp, Artificial Sequence
  Synthetic oligonucleotide
catgcctagtccaacattttttcccag

SEQ ID NO: 6554 - DNA, 27 bp, Artificial Sequence
  Synthetic oligonucleotide
atgcctagtccaacattttttcccagt

SEQ ID NO: 6555 - DNA, 27 bp, Artificial Sequence
  Synthetic oligonucleotide
tgcctagtccaacattttttcccagtg

SEQ ID NO: 6556 - DNA, 27 bp, Artificial Sequence
  Synthetic oligonucleotide
gcctagtccaacattttttcccagtga

SEQ ID NO: 6557 - DNA, 27 bp, Artificial Sequence
  Synthetic oligonucleotide
cctagtccaacattttttcccagtgag

SEQ ID NO: 6558 - DNA, 27 bp, Artificial Sequence
  Synthetic oligonucleotide
ctagtccaacattttttcccagtgagt

SEQ ID NO: 6559 - DNA, 27 bp, Artificial Sequence
  Synthetic oligonucleotide
tagtccaacattttttcccagtgagtc

SEQ ID NO: 6560 - DNA, 27 bp, Artificial Sequence
  Synthetic oligonucleotide
agtccaacattttttcccagtgagtca

SEQ ID NO: 6561 - DNA, 27 bp, Artificial Sequence
  Synthetic oligonucleotide
gtccaacattttttcccagtgagtcac

SEQ ID NO: 6562 - DNA, 27 bp, Artificial Sequence
  Synthetic oligonucleotide
tccaacattttttcccagtgagtcaca

SEQ ID NO: 6563 - DNA, 27 bp, Artificial Sequence
  Synthetic oligonucleotide
ccaacattttttcccagtgagtcacat

SEQ ID NO: 6564 - DNA, 27 bp, Artificial Sequence
  Synthetic oligonucleotide
caacattttttcccagtgagtcacatc

SEQ ID NO: 6565 - DNA, 27 bp, Artificial Sequence
  Synthetic oligonucleotide
aacattttttcccagtgagtcacatcc

SEQ ID NO: 6566 - DNA, 27 bp, Artificial Sequence
  Synthetic oligonucleotide
acattttttcccagtgagtcacatcct

SEQ ID NO: 6567 - DNA, 27 bp, Artificial Sequence
  Synthetic oligonucleotide
cattttttcccagtgagtcacatcctg

SEQ ID NO: 6568 - DNA, 27 bp, Artificial Sequence
  Synthetic oligonucleotide
attttttcccagtgagtcacatcctgg

SEQ ID NO: 6569 - DNA, 27 bp, Artificial Sequence
  Synthetic oligonucleotide
ttttttcccagtgagtcacatcctggg

SEQ ID NO: 6570 - DNA, 27 bp, Artificial Sequence
  Synthetic oligonucleotide
tttttcccagtgagtcacatcctggga

SEQ ID NO: 6571 - DNA, 27 bp, Artificial Sequence
  Synthetic oligonucleotide
ttttcccagtgagtcacatcctgggat

SEQ ID NO: 6572 - DNA, 27 bp, Artificial Sequence
  Synthetic oligonucleotide
tttcccagtgagtcacatcctgggatc

SEQ ID NO: 6573 - DNA, 27 bp, Artificial Sequence
  Synthetic oligonucleotide
ttcccagtgagtcacatcctgggatcc

SEQ ID NO: 6574 - DNA, 27 bp, Artificial Sequence
  Synthetic oligonucleotide
tcccagtgagtcacatcctgggatcca

SEQ ID NO: 6575 - DNA, 27 bp, Artificial Sequence
  Synthetic oligonucleotide
cccagtgagtcacatcctgggatccag

SEQ ID NO: 6576 - DNA, 27 bp, Artificial Sequence
  Synthetic oligonucleotide
ccagtgagtcacatcctgggatccagt

SEQ ID NO: 6577 - DNA, 27 bp, Artificial Sequence
  Synthetic oligonucleotide
cagtgagtcacatcctgggatccagtg

SEQ ID NO: 6578 - DNA, 27 bp, Artificial Sequence
  Synthetic oligonucleotide
agtgagtcacatcctgggatccagtgt

SEQ ID NO: 6579 - DNA, 27 bp, Artificial Sequence
  Synthetic oligonucleotide
gtgagtcacatcctgggatccagtgta

SEQ ID NO: 6580 - DNA, 27 bp, Artificial Sequence
  Synthetic oligonucleotide
tgagtcacatcctgggatccagtgtat

SEQ ID NO: 6581 - DNA, 27 bp, Artificial Sequence
  Synthetic oligonucleotide
gagtcacatcctgggatccagtgtata

SEQ ID NO: 6582 - DNA, 27 bp, Artificial Sequence
  Synthetic oligonucleotide
agtcacatcctgggatccagtgtataa

SEQ ID NO: 6583 - DNA, 27 bp, Artificial Sequence
  Synthetic oligonucleotide
gtcacatcctgggatccagtgtataaa

SEQ ID NO: 6584 - DNA, 27 bp, Artificial Sequence
  Synthetic oligonucleotide
tcacatcctgggatccagtgtataaat

SEQ ID NO: 6585 - DNA, 27 bp, Artificial Sequence
  Synthetic oligonucleotide
cacatcctgggatccagtgtataaatc

SEQ ID NO: 6586 - DNA, 27 bp, Artificial Sequence
  Synthetic oligonucleotide
acatcctgggatccagtgtataaatcc

SEQ ID NO: 6587 - DNA, 27 bp, Artificial Sequence
  Synthetic oligonucleotide
catcctgggatccagtgtataaatcca

SEQ ID NO: 6588 - DNA, 27 bp, Artificial Sequence
  Synthetic oligonucleotide
atcctgggatccagtgtataaatccaa

SEQ ID NO: 6589 - DNA, 27 bp, Artificial Sequence
  Synthetic oligonucleotide
tcctgggatccagtgtataaatccaat

SEQ ID NO: 6590 - DNA, 27 bp, Artificial Sequence
  Synthetic oligonucleotide
cctgggatccagtgtataaatccaata

SEQ ID NO: 6591 - DNA, 27 bp, Artificial Sequence
  Synthetic oligonucleotide
ctgggatccagtgtataaatccaatat

SEQ ID NO: 6592 - DNA, 27 bp, Artificial Sequence
  Synthetic oligonucleotide
tgggatccagtgtataaatccaatatc

SEQ ID NO: 6593 - DNA, 27 bp, Artificial Sequence
  Synthetic oligonucleotide
gggatccagtgtataaatccaatatca

SEQ ID NO: 6594 - DNA, 27 bp, Artificial Sequence
  Synthetic oligonucleotide
gatccagtgtataaatccaatatcatg

SEQ ID NO: 6595 - DNA, 27 bp, Artificial Sequence
  Synthetic oligonucleotide
atccagtgtataaatccaatatcatgt

SEQ ID NO: 6596 - DNA, 27 bp, Artificial Sequence
  Synthetic oligonucleotide
tccagtgtataaatccaatatcatgtc

SEQ ID NO: 6597 - DNA, 27 bp, Artificial Sequence
  Synthetic oligonucleotide
cagtgtataaatccaatatcatgtctt

SEQ ID NO: 6598 - DNA, 27 bp, Artificial Sequence
  Synthetic oligonucleotide
agtgtataaatccaatatcatgtcttg

SEQ ID NO: 6599 - DNA, 27 bp, Artificial Sequence
  Synthetic oligonucleotide
gtgtataaatccaatatcatgtcttgt

SEQ ID NO: 6600 - DNA, 27 bp, Artificial Sequence
  Synthetic oligonucleotide
tgtataaatccaatatcatgtcttgtg

SEQ ID NO: 6601 - DNA, 27 bp, Artificial Sequence
  Synthetic oligonucleotide
gtataaatccaatatcatgtcttgtgc

SEQ ID NO: 6602 - DNA, 27 bp, Artificial Sequence
  Synthetic oligonucleotide
tataaatccaatatcatgtcttgtgca

SEQ ID NO: 6603 - DNA, 27 bp, Artificial Sequence
  Synthetic oligonucleotide
ataaatccaatatcatgtcttgtgcat

SEQ ID NO: 6604 - DNA, 27 bp, Artificial Sequence
  Synthetic oligonucleotide
taaatccaatatcatgtcttgtgcata

SEQ ID NO: 6605 - DNA, 27 bp, Artificial Sequence
  Synthetic oligonucleotide
aaatccaatatcatgtcttgtgcataa

SEQ ID NO: 6606 - DNA, 27 bp, Artificial Sequence
  Synthetic oligonucleotide
aatccaatatcatgtcttgtgcataat

SEQ ID NO: 6607 - DNA, 27 bp, Artificial Sequence
  Synthetic oligonucleotide
atccaatatcatgtcttgtgcataatt

SEQ ID NO: 6608 - DNA, 27 bp, Artificial Sequence
  Synthetic oligonucleotide
tccaatatcatgtcttgtgcataattc

SEQ ID NO: 6609 - DNA, 27 bp, Artificial Sequence
  Synthetic oligonucleotide
ccaatatcatgtcttgtgcataattct

SEQ ID NO: 6610 - DNA, 27 bp, Artificial Sequence
  Synthetic oligonucleotide
caatatcatgtcttgtgcataattctt

SEQ ID NO: 6611 - DNA, 27 bp, Artificial Sequence
  Synthetic oligonucleotide
aatatcatgtcttgtgcataattcttc

SEQ ID NO: 6612 - DNA, 27 bp, Artificial Sequence
  Synthetic oligonucleotide
atatcatgtcttgtgcataattcttcc

SEQ ID NO: 6613 - DNA, 27 bp, Artificial Sequence
  Synthetic oligonucleotide
tatcatgtcttgtgcataattcttcca

SEQ ID NO: 6614 - DNA, 27 bp, Artificial Sequence
  Synthetic oligonucleotide
atcatgtcttgtgcataattcttccaa

SEQ ID NO: 6615 - DNA, 27 bp, Artificial Sequence
  Synthetic oligonucleotide
tcatgtcttgtgcataattcttccaaa

SEQ ID NO: 6616 - DNA, 27 bp, Artificial Sequence
  Synthetic oligonucleotide
catgtcttgtgcataattcttccaaag

SEQ ID NO: 6617 - DNA, 27 bp, Artificial Sequence
  Synthetic oligonucleotide
atgtcttgtgcataattcttccaaagg

SEQ ID NO: 6618 - DNA, 27 bp, Artificial Sequence
  Synthetic oligonucleotide
tgtcttgtgcataattcttccaaagga

SEQ ID NO: 6619 - DNA, 27 bp, Artificial Sequence
  Synthetic oligonucleotide
gtcttgtgcataattcttccaaaggat

SEQ ID NO: 6620 - DNA, 27 bp, Artificial Sequence
  Synthetic oligonucleotide
tcttgtgcataattcttccaaaggatc

SEQ ID NO: 6621 - DNA, 27 bp, Artificial Sequence
  Synthetic oligonucleotide
cttgtgcataattcttccaaaggatct

SEQ ID NO: 6622 - DNA, 27 bp, Artificial Sequence
  Synthetic oligonucleotide
ttgtgcataattcttccaaaggatctt

SEQ ID NO: 6623 - DNA, 27 bp, Artificial Sequence
  Synthetic oligonucleotide
tgtgcataattcttccaaaggatctta

SEQ ID NO: 6624 - DNA, 27 bp, Artificial Sequence
  Synthetic oligonucleotide
gtgcataattcttccaaaggatcttat

SEQ ID NO: 6625 - DNA, 27 bp, Artificial Sequence
  Synthetic oligonucleotide
tgcataattcttccaaaggatcttatt

SEQ ID NO: 6626 - DNA, 27 bp, Artificial Sequence
  Synthetic oligonucleotide
gcataattcttccaaaggatcttattt

SEQ ID NO: 6627 - DNA, 27 bp, Artificial Sequence
  Synthetic oligonucleotide
cataattcttccaaaggatcttatttt

SEQ ID NO: 6628 - DNA, 27 bp, Artificial Sequence
  Synthetic oligonucleotide
ataattcttccaaaggatcttattttg

SEQ ID NO: 6629 - DNA, 27 bp, Artificial Sequence
  Synthetic oligonucleotide
taattcttccaaaggatcttattttgt

SEQ ID NO: 6630 - DNA, 27 bp, Artificial Sequence
  Synthetic oligonucleotide
aattcttccaaaggatcttattttgtg

SEQ ID NO: 6631 - DNA, 27 bp, Artificial Sequence
  Synthetic oligonucleotide
attcttccaaaggatcttattttgtga

SEQ ID NO: 6632 - DNA, 27 bp, Artificial Sequence
  Synthetic oligonucleotide
ttcttccaaaggatcttattttgtgaa

SEQ ID NO: 6633 - DNA, 27 bp, Artificial Sequence
  Synthetic oligonucleotide
tcttccaaaggatcttattttgtgaac

SEQ ID NO: 6634 - DNA, 27 bp, Artificial Sequence
  Synthetic oligonucleotide
cttccaaaggatcttattttgtgaact

SEQ ID NO: 6635 - DNA, 27 bp, Artificial Sequence
  Synthetic oligonucleotide
ttccaaaggatcttattttgtgaacta

SEQ ID NO: 6636 - DNA, 27 bp, Artificial Sequence
  Synthetic oligonucleotide
tccaaaggatcttattttgtgaactat

SEQ ID NO: 6637 - DNA, 27 bp, Artificial Sequence
  Synthetic oligonucleotide
ccaaaggatcttattttgtgaactata

SEQ ID NO: 6638 - DNA, 27 bp, Artificial Sequence
  Synthetic oligonucleotide
caaaggatcttattttgtgaactatat

SEQ ID NO: 6639 - DNA, 27 bp, Artificial Sequence
  Synthetic oligonucleotide
aaaggatcttattttgtgaactatatc

SEQ ID NO: 6640 - DNA, 27 bp, Artificial Sequence
  Synthetic oligonucleotide
aaggatcttattttgtgaactatatca

SEQ ID NO: 6641 - DNA, 27 bp, Artificial Sequence
  Synthetic oligonucleotide
aggatcttattttgtgaactatatcag

SEQ ID NO: 6642 - DNA, 27 bp, Artificial Sequence
  Synthetic oligonucleotide
ggatcttattttgtgaactatatcagt

SEQ ID NO: 6643 - DNA, 27 bp, Artificial Sequence
  Synthetic oligonucleotide
gatcttattttgtgaactatatcagta

SEQ ID NO: 6644 - DNA, 27 bp, Artificial Sequence
  Synthetic oligonucleotide
tcttattttgtgaactatatcagtagt

SEQ ID NO: 6645 - DNA, 27 bp, Artificial Sequence
  Synthetic oligonucleotide
cttattttgtgaactatatcagtagtg

SEQ ID NO: 6646 - DNA, 27 bp, Artificial Sequence
  Synthetic oligonucleotide
ttattttgtgaactatatcagtagtgt

SEQ ID NO: 6647 - DNA, 27 bp, Artificial Sequence
  Synthetic oligonucleotide
tattttgtgaactatatcagtagtgta

SEQ ID NO: 6648 - DNA, 27 bp, Artificial Sequence
  Synthetic oligonucleotide
attttgtgaactatatcagtagtgtac

SEQ ID NO: 6649 - DNA, 27 bp, Artificial Sequence
  Synthetic oligonucleotide
ttttgtgaactatatcagtagtgtaca

SEQ ID NO: 6650 - DNA, 27 bp, Artificial Sequence
  Synthetic oligonucleotide
tttgtgaactatatcagtagtgtacat

SEQ ID NO: 6651 - DNA, 27 bp, Artificial Sequence
  Synthetic oligonucleotide
ttgtgaactatatcagtagtgtacatt

SEQ ID NO: 6652 - DNA, 27 bp, Artificial Sequence
  Synthetic oligonucleotide
tgtgaactatatcagtagtgtacatta

SEQ ID NO: 6653 - DNA, 27 bp, Artificial Sequence
  Synthetic oligonucleotide
gtgaactatatcagtagtgtacattac

SEQ ID NO: 6654 - DNA, 27 bp, Artificial Sequence
  Synthetic oligonucleotide
tgaactatatcagtagtgtacattacc

SEQ ID NO: 6655 - DNA, 27 bp, Artificial Sequence
  Synthetic oligonucleotide
gaactatatcagtagtgtacattacca

SEQ ID NO: 6656 - DNA, 27 bp, Artificial Sequence
  Synthetic oligonucleotide
aactatatcagtagtgtacattaccat

SEQ ID NO: 6657 - DNA, 27 bp, Artificial Sequence
  Synthetic oligonucleotide
ctatatcagtagtgtacattaccatat

SEQ ID NO: 6658 - DNA, 27 bp, Artificial Sequence
  Synthetic oligonucleotide
tatatcagtagtgtacattaccatata

SEQ ID NO: 6659 - DNA, 27 bp, Artificial Sequence
  Synthetic oligonucleotide
atcagtagtgtacattaccatataatg

SEQ ID NO: 6660 - DNA, 27 bp, Artificial Sequence
  Synthetic oligonucleotide
tcagtagtgtacattaccatataatgt

SEQ ID NO: 6661 - DNA, 27 bp, Artificial Sequence
  Synthetic oligonucleotide
cagtagtgtacattaccatataatgta

SEQ ID NO: 6662 - DNA, 27 bp, Artificial Sequence
  Synthetic oligonucleotide
agtagtgtacattaccatataatgtaa

SEQ ID NO: 6663 - DNA, 27 bp, Artificial Sequence
  Synthetic oligonucleotide
gtagtgtacattaccatataatgtaaa

SEQ ID NO: 6664 - DNA, 27 bp, Artificial Sequence
  Synthetic oligonucleotide
tagtgtacattaccatataatgtaaaa

SEQ ID NO: 6665 - DNA, 27 bp, Artificial Sequence
  Synthetic oligonucleotide
agtgtacattaccatataatgtaaaaa

SEQ ID NO: 6666 - DNA, 27 bp, Artificial Sequence
  Synthetic oligonucleotide
gtgtacattaccatataatgtaaaaag

SEQ ID NO: 6667 - DNA, 27 bp, Artificial Sequence
  Synthetic oligonucleotide
tgtacattaccatataatgtaaaaaga

SEQ ID NO: 6668 - DNA, 27 bp, Artificial Sequence
  Synthetic oligonucleotide
gtacattaccatataatgtaaaaagat

SEQ ID NO: 6669 - DNA, 27 bp, Artificial Sequence
  Synthetic oligonucleotide
tacattaccatataatgtaaaaagatc

SEQ ID NO: 6670 - DNA, 27 bp, Artificial Sequence
  Synthetic oligonucleotide
acattaccatataatgtaaaaagatct

SEQ ID NO: 6671 - DNA, 27 bp, Artificial Sequence
  Synthetic oligonucleotide
cattaccatataatgtaaaaagatcta

SEQ ID NO: 6672 - DNA, 27 bp, Artificial Sequence
  Synthetic oligonucleotide
attaccatataatgtaaaaagatctac

SEQ ID NO: 6673 - DNA, 27 bp, Artificial Sequence
  Synthetic oligonucleotide
ttaccatataatgtaaaaagatctaca

SEQ ID NO: 6674 - DNA, 27 bp, Artificial Sequence
  Synthetic oligonucleotide
taccatataatgtaaaaagatctacat

SEQ ID NO: 6675 - DNA, 27 bp, Artificial Sequence
  Synthetic oligonucleotide
accatataatgtaaaaagatctacata

SEQ ID NO: 6676 - DNA, 27 bp, Artificial Sequence
  Synthetic oligonucleotide
ccatataatgtaaaaagatctacatac

SEQ ID NO: 6677 - DNA, 27 bp, Artificial Sequence
  Synthetic oligonucleotide
catataatgtaaaaagatctacataca

SEQ ID NO: 6678 - DNA, 27 bp, Artificial Sequence
  Synthetic oligonucleotide
atataatgtaaaaagatctacatacaa

SEQ ID NO: 6679 - DNA, 27 bp, Artificial Sequence
  Synthetic oligonucleotide
tataatgtaaaaagatctacatacaaa

SEQ ID NO: 6680 - DNA, 27 bp, Artificial Sequence
  Synthetic oligonucleotide
ataatgtaaaaagatctacatacaaac

SEQ ID NO: 6681 - DNA, 27 bp, Artificial Sequence
  Synthetic oligonucleotide
taatgtaaaaagatctacatacaaaca

SEQ ID NO: 6682 - DNA, 27 bp, Artificial Sequence
  Synthetic oligonucleotide
aatgtaaaaagatctacatacaaacaa

SEQ ID NO: 6683 - DNA, 27 bp, Artificial Sequence
  Synthetic oligonucleotide
atgtaaaaagatctacatacaaacaat

SEQ ID NO: 6684 - DNA, 27 bp, Artificial Sequence
  Synthetic oligonucleotide
tgtaaaaagatctacatacaaacaatg

SEQ ID NO: 6685 - DNA, 27 bp, Artificial Sequence
  Synthetic oligonucleotide
gtaaaaagatctacatacaaacaatgc

SEQ ID NO: 6686 - DNA, 27 bp, Artificial Sequence
  Synthetic oligonucleotide
taaaaagatctacatacaaacaatgca

SEQ ID NO: 6687 - DNA, 27 bp, Artificial Sequence
  Synthetic oligonucleotide
aaaaagatctacatacaaacaatgcaa

SEQ ID NO: 6688 - DNA, 27 bp, Artificial Sequence
  Synthetic oligonucleotide
aaaagatctacatacaaacaatgcaac

SEQ ID NO: 6689 - DNA, 27 bp, Artificial Sequence
  Synthetic oligonucleotide
aaagatctacatacaaacaatgcaacc

SEQ ID NO: 6690 - DNA, 27 bp, Artificial Sequence
  Synthetic oligonucleotide
aagatctacatacaaacaatgcaacca

SEQ ID NO: 6691 - DNA, 27 bp, Artificial Sequence
  Synthetic oligonucleotide
agatctacatacaaacaatgcaaccaa

SEQ ID NO: 6692 - DNA, 27 bp, Artificial Sequence
  Synthetic oligonucleotide
gatctacatacaaacaatgcaaccaac

SEQ ID NO: 6693 - DNA, 27 bp, Artificial Sequence
  Synthetic oligonucleotide
atctacatacaaacaatgcaaccaact

SEQ ID NO: 6694 - DNA, 27 bp, Artificial Sequence
  Synthetic oligonucleotide
tctacatacaaacaatgcaaccaacta

SEQ ID NO: 6695 - DNA, 27 bp, Artificial Sequence
  Synthetic oligonucleotide
ctacatacaaacaatgcaaccaactat

SEQ ID NO: 6696 - DNA, 27 bp, Artificial Sequence
  Synthetic oligonucleotide
tacatacaaacaatgcaaccaactatc

SEQ ID NO: 6697 - DNA, 27 bp, Artificial Sequence
  Synthetic oligonucleotide
acatacaaacaatgcaaccaactatcc

SEQ ID NO: 6698 - DNA, 27 bp, Artificial Sequence
  Synthetic oligonucleotide
catacaaacaatgcaaccaactatcca

SEQ ID NO: 6699 - DNA, 27 bp, Artificial Sequence
  Synthetic oligonucleotide
atacaaacaatgcaaccaactatccaa

SEQ ID NO: 6700 - DNA, 27 bp, Artificial Sequence
  Synthetic oligonucleotide
tacaaacaatgcaaccaactatccaag

SEQ ID NO: 6701 - DNA, 27 bp, Artificial Sequence
  Synthetic oligonucleotide
acaaacaatgcaaccaactatccaagt

SEQ ID NO: 6702 - DNA, 27 bp, Artificial Sequence
  Synthetic oligonucleotide
caaacaatgcaaccaactatccaagtg

SEQ ID NO: 6703 - DNA, 27 bp, Artificial Sequence
  Synthetic oligonucleotide
aaacaatgcaaccaactatccaagtgt

SEQ ID NO: 6704 - DNA, 27 bp, Artificial Sequence
  Synthetic oligonucleotide
aacaatgcaaccaactatccaagtgtt

SEQ ID NO: 6705 - DNA, 27 bp, Artificial Sequence
  Synthetic oligonucleotide
acaatgcaaccaactatccaagtgtta

SEQ ID NO: 6706 - DNA, 27 bp, Artificial Sequence
  Synthetic oligonucleotide
caatgcaaccaactatccaagtgttat

SEQ ID NO: 6707 - DNA, 27 bp, Artificial Sequence
  Synthetic oligonucleotide
aatgcaaccaactatccaagtgttata

SEQ ID NO: 6708 - DNA, 27 bp, Artificial Sequence
  Synthetic oligonucleotide
atgcaaccaactatccaagtgttatac

SEQ ID NO: 6709 - DNA, 27 bp, Artificial Sequence
  Synthetic oligonucleotide
accaactatccaagtgttataccaact

SEQ ID NO: 6710 - DNA, 27 bp, Artificial Sequence
  Synthetic oligonucleotide
ccaactatccaagtgttataccaacta

SEQ ID NO: 6711 - DNA, 27 bp, Artificial Sequence
  Synthetic oligonucleotide
actatccaagtgttataccaactaaaa

SEQ ID NO: 6712 - DNA, 27 bp, Artificial Sequence
  Synthetic oligonucleotide
ctatccaagtgttataccaactaaaac

SEQ ID NO: 6713 - DNA, 27 bp, Artificial Sequence
  Synthetic oligonucleotide
tccaagtgttataccaactaaaacccc

SEQ ID NO: 6714 - DNA, 27 bp, Artificial Sequence
  Synthetic oligonucleotide
ccaagtgttataccaactaaaaccccc

SEQ ID NO: 6715 - DNA, 27 bp, Artificial Sequence
  Synthetic oligonucleotide
caagtgttataccaactaaaaccccca

SEQ ID NO: 6716 - DNA, 27 bp, Artificial Sequence
  Synthetic oligonucleotide
aagtgttataccaactaaaacccccaa

SEQ ID NO: 6717 - DNA, 27 bp, Artificial Sequence
  Synthetic oligonucleotide
agtgttataccaactaaaacccccaat

SEQ ID NO: 6718 - DNA, 27 bp, Artificial Sequence
  Synthetic oligonucleotide
gtgttataccaactaaaacccccaata

SEQ ID NO: 6719 - DNA, 27 bp, Artificial Sequence
  Synthetic oligonucleotide
tgttataccaactaaaacccccaataa

SEQ ID NO: 6720 - DNA, 27 bp, Artificial Sequence
  Synthetic oligonucleotide
gttataccaactaaaacccccaataaa

SEQ ID NO: 6721 - DNA, 27 bp, Artificial Sequence
  Synthetic oligonucleotide
ttataccaactaaaacccccaataaac

SEQ ID NO: 6722 - DNA, 27 bp, Artificial Sequence
  Synthetic oligonucleotide
tataccaactaaaacccccaataaacc

SEQ ID NO: 6723 - DNA, 27 bp, Artificial Sequence
  Synthetic oligonucleotide
ataccaactaaaacccccaataaacct

SEQ ID NO: 6724 - DNA, 27 bp, Artificial Sequence
  Synthetic oligonucleotide
taccaactaaaacccccaataaacctt

SEQ ID NO: 6725 - DNA, 27 bp, Artificial Sequence
  Synthetic oligonucleotide
accaactaaaacccccaataaaccttg

SEQ ID NO: 6726 - DNA, 27 bp, Artificial Sequence
  Synthetic oligonucleotide
ccaactaaaacccccaataaaccttga

SEQ ID NO: 6727 - DNA, 27 bp, Artificial Sequence
  Synthetic oligonucleotide
caactaaaacccccaataaaccttgaa

SEQ ID NO: 6728 - DNA, 27 bp, Artificial Sequence
  Synthetic oligonucleotide
aactaaaacccccaataaaccttgaac

SEQ ID NO: 6729 - DNA, 27 bp, Artificial Sequence
  Synthetic oligonucleotide
actaaaacccccaataaaccttgaaca

SEQ ID NO: 6730 - DNA, 27 bp, Artificial Sequence
  Synthetic oligonucleotide
ctaaaacccccaataaaccttgaacag

SEQ ID NO: 6731 - DNA, 27 bp, Artificial Sequence
  Synthetic oligonucleotide
taaaacccccaataaaccttgaacagt

SEQ ID NO: 6732 - DNA, 27 bp, Artificial Sequence
  Synthetic oligonucleotide
aaaacccccaataaaccttgaacagtg

SEQ ID NO: 6733 - DNA, 27 bp, Artificial Sequence
  Synthetic oligonucleotide
aaacccccaataaaccttgaacagtga

SEQ ID NO: 6734 - DNA, 27 bp, Artificial Sequence
  Synthetic oligonucleotide
aacccccaataaaccttgaacagtgac

SEQ ID NO: 6735 - DNA, 27 bp, Artificial Sequence
  Synthetic oligonucleotide
acccccaataaaccttgaacagtgact

SEQ ID NO: 6736 - DNA, 27 bp, Artificial Sequence
  Synthetic oligonucleotide
cccccaataaaccttgaacagtgacta

SEQ ID NO: 6737 - DNA, 27 bp, Artificial Sequence
  Synthetic oligonucleotide
ccccaataaaccttgaacagtgactac

SEQ ID NO: 6738 - DNA, 27 bp, Artificial Sequence
  Synthetic oligonucleotide
cccaataaaccttgaacagtgactact

SEQ ID NO: 6739 - DNA, 27 bp, Artificial Sequence
  Synthetic oligonucleotide
ccaataaaccttgaacagtgactactt

SEQ ID NO: 6740 - DNA, 27 bp, Artificial Sequence
  Synthetic oligonucleotide
caataaaccttgaacagtgactacttt

SEQ ID NO: 6741 - DNA, 27 bp, Artificial Sequence
  Synthetic oligonucleotide
aataaaccttgaacagtgactactttg

SEQ ID NO: 6742 - DNA, 27 bp, Artificial Sequence
  Synthetic oligonucleotide
ataaaccttgaacagtgactactttgg

SEQ ID NO: 6743 - DNA, 27 bp, Artificial Sequence
  Synthetic oligonucleotide
taaaccttgaacagtgactactttggt

SEQ ID NO: 6744 - DNA, 27 bp, Artificial Sequence
  Synthetic oligonucleotide
aaaccttgaacagtgactactttggtt

SEQ ID NO: 6745 - DNA, 27 bp, Artificial Sequence
  Synthetic oligonucleotide
aaccttgaacagtgactactttggtta

SEQ ID NO: 6746 - DNA, 27 bp, Artificial Sequence
  Synthetic oligonucleotide
accttgaacagtgactactttggttaa

SEQ ID NO: 6747 - DNA, 27 bp, Artificial Sequence
  Synthetic oligonucleotide
ccttgaacagtgactactttggttaat

SEQ ID NO: 6748 - DNA, 27 bp, Artificial Sequence
  Synthetic oligonucleotide
cttgaacagtgactactttggttaatt

SEQ ID NO: 6749 - DNA, 27 bp, Artificial Sequence
  Synthetic oligonucleotide
ttgaacagtgactactttggttaattc

SEQ ID NO: 6750 - DNA, 27 bp, Artificial Sequence
  Synthetic oligonucleotide
tgaacagtgactactttggttaattca

SEQ ID NO: 6751 - DNA, 27 bp, Artificial Sequence
  Synthetic oligonucleotide
gaacagtgactactttggttaattcat

SEQ ID NO: 6752 - DNA, 27 bp, Artificial Sequence
  Synthetic oligonucleotide
aacagtgactactttggttaattcatt

SEQ ID NO: 6753 - DNA, 27 bp, Artificial Sequence
  Synthetic oligonucleotide
acagtgactactttggttaattcatta

SEQ ID NO: 6754 - DNA, 27 bp, Artificial Sequence
  Synthetic oligonucleotide
cagtgactactttggttaattcattat

SEQ ID NO: 6755 - DNA, 27 bp, Artificial Sequence
  Synthetic oligonucleotide
agtgactactttggttaattcattata

SEQ ID NO: 6756 - DNA, 27 bp, Artificial Sequence
  Synthetic oligonucleotide
gtgactactttggttaattcattatat

SEQ ID NO: 6757 - DNA, 27 bp, Artificial Sequence
  Synthetic oligonucleotide
tgactactttggttaattcattatatt

SEQ ID NO: 6758 - DNA, 27 bp, Artificial Sequence
  Synthetic oligonucleotide
gactactttggttaattcattatatta

SEQ ID NO: 6759 - DNA, 27 bp, Artificial Sequence
  Synthetic oligonucleotide
actactttggttaattcattatattaa

SEQ ID NO: 6760 - DNA, 27 bp, Artificial Sequence
  Synthetic oligonucleotide
ctactttggttaattcattatattaag

SEQ ID NO: 6761 - DNA, 27 bp, Artificial Sequence
  Synthetic oligonucleotide
tactttggttaattcattatattaaga

SEQ ID NO: 6762 - DNA, 27 bp, Artificial Sequence
  Synthetic oligonucleotide
actttggttaattcattatattaagat

SEQ ID NO: 6763 - DNA, 27 bp, Artificial Sequence
  Synthetic oligonucleotide
ctttggttaattcattatattaagata

SEQ ID NO: 6764 - DNA, 27 bp, Artificial Sequence
  Synthetic oligonucleotide
tttggttaattcattatattaagatat

SEQ ID NO: 6765 - DNA, 27 bp, Artificial Sequence
  Synthetic oligonucleotide
ttggttaattcattatattaagatata

SEQ ID NO: 6766 - DNA, 27 bp, Artificial Sequence
  Synthetic oligonucleotide
tggttaattcattatattaagatataa

SEQ ID NO: 6767 - DNA, 27 bp, Artificial Sequence
  Synthetic oligonucleotide
ggttaattcattatattaagatataaa

SEQ ID NO: 6768 - DNA, 27 bp, Artificial Sequence
  Synthetic oligonucleotide
gttaattcattatattaagatataaag

SEQ ID NO: 6769 - DNA, 27 bp, Artificial Sequence
  Synthetic oligonucleotide
ttaattcattatattaagatataaagt

SEQ ID NO: 6770 - DNA, 27 bp, Artificial Sequence
  Synthetic oligonucleotide
taattcattatattaagatataaagtc

SEQ ID NO: 6771 - DNA, 27 bp, Artificial Sequence
  Synthetic oligonucleotide
aattcattatattaagatataaagtca

SEQ ID NO: 6772 - DNA, 27 bp, Artificial Sequence
  Synthetic oligonucleotide
attcattatattaagatataaagtcat

SEQ ID NO: 6773 - DNA, 27 bp, Artificial Sequence
  Synthetic oligonucleotide
ttcattatattaagatataaagtcata

SEQ ID NO: 6774 - DNA, 27 bp, Artificial Sequence
  Synthetic oligonucleotide
tcattatattaagatataaagtcataa

SEQ ID NO: 6775 - DNA, 27 bp, Artificial Sequence
  Synthetic oligonucleotide
cattatattaagatataaagtcataaa

SEQ ID NO: 6776 - DNA, 27 bp, Artificial Sequence
  Synthetic oligonucleotide
attatattaagatataaagtcataaag

SEQ ID NO: 6777 - DNA, 27 bp, Artificial Sequence
  Synthetic oligonucleotide
ttatattaagatataaagtcataaagc

SEQ ID NO: 6778 - DNA, 27 bp, Artificial Sequence
  Synthetic oligonucleotide
tatattaagatataaagtcataaagct

SEQ ID NO: 6779 - DNA, 27 bp, Artificial Sequence
  Synthetic oligonucleotide
atattaagatataaagtcataaagctg

SEQ ID NO: 6780 - DNA, 27 bp, Artificial Sequence
  Synthetic oligonucleotide
tattaagatataaagtcataaagctgc

SEQ ID NO: 6781 - DNA, 27 bp, Artificial Sequence
  Synthetic oligonucleotide
attaagatataaagtcataaagctgct

SEQ ID NO: 6782 - DNA, 27 bp, Artificial Sequence
  Synthetic oligonucleotide
ttaagatataaagtcataaagctgcta

SEQ ID NO: 6783 - DNA, 27 bp, Artificial Sequence
  Synthetic oligonucleotide
taagatataaagtcataaagctgctag

SEQ ID NO: 6784 - DNA, 27 bp, Artificial Sequence
  Synthetic oligonucleotide
aagatataaagtcataaagctgctagt

SEQ ID NO: 6785 - DNA, 27 bp, Artificial Sequence
  Synthetic oligonucleotide
agatataaagtcataaagctgctagtt

SEQ ID NO: 6786 - DNA, 27 bp, Artificial Sequence
  Synthetic oligonucleotide
gatataaagtcataaagctgctagtta

SEQ ID NO: 6787 - DNA, 27 bp, Artificial Sequence
  Synthetic oligonucleotide
atataaagtcataaagctgctagttat

SEQ ID NO: 6788 - DNA, 27 bp, Artificial Sequence
  Synthetic oligonucleotide
tataaagtcataaagctgctagttatt

SEQ ID NO: 6789 - DNA, 27 bp, Artificial Sequence
  Synthetic oligonucleotide
ataaagtcataaagctgctagttatta

SEQ ID NO: 6790 - DNA, 27 bp, Artificial Sequence
  Synthetic oligonucleotide
taaagtcataaagctgctagttattat

SEQ ID NO: 6791 - DNA, 27 bp, Artificial Sequence
  Synthetic oligonucleotide
aaagtcataaagctgctagttattata

SEQ ID NO: 6792 - DNA, 27 bp, Artificial Sequence
  Synthetic oligonucleotide
aagtcataaagctgctagttattatat

SEQ ID NO: 6793 - DNA, 27 bp, Artificial Sequence
  Synthetic oligonucleotide
agtcataaagctgctagttattatatt

SEQ ID NO: 6794 - DNA, 27 bp, Artificial Sequence
  Synthetic oligonucleotide
gtcataaagctgctagttattatatta

SEQ ID NO: 6795 - DNA, 27 bp, Artificial Sequence
  Synthetic oligonucleotide
tcataaagctgctagttattatattaa

SEQ ID NO: 6796 - DNA, 27 bp, Artificial Sequence
  Synthetic oligonucleotide
cataaagctgctagttattatattaat

SEQ ID NO: 6797 - DNA, 27 bp, Artificial Sequence
  Synthetic oligonucleotide
ataaagctgctagttattatattaatt

SEQ ID NO: 6798 - DNA, 27 bp, Artificial Sequence
  Synthetic oligonucleotide
taaagctgctagttattatattaattt

SEQ ID NO: 6799 - DNA, 27 bp, Artificial Sequence
  Synthetic oligonucleotide
aaagctgctagttattatattaatttg

SEQ ID NO: 6800 - DNA, 27 bp, Artificial Sequence
  Synthetic oligonucleotide
aagctgctagttattatattaatttgg

SEQ ID NO: 6801 - DNA, 27 bp, Artificial Sequence
  Synthetic oligonucleotide
agctgctagttattatattaatttgga

SEQ ID NO: 6802 - DNA, 27 bp, Artificial Sequence
  Synthetic oligonucleotide
gctgctagttattatattaatttggaa

SEQ ID NO: 6803 - DNA, 27 bp, Artificial Sequence
  Synthetic oligonucleotide
ctgctagttattatattaatttggaaa

SEQ ID NO: 6804 - DNA, 27 bp, Artificial Sequence
  Synthetic oligonucleotide
tgctagttattatattaatttggaaat

SEQ ID NO: 6805 - DNA, 27 bp, Artificial Sequence
  Synthetic oligonucleotide
gctagttattatattaatttggaaata

SEQ ID NO: 6806 - DNA, 27 bp, Artificial Sequence
  Synthetic oligonucleotide
ctagttattatattaatttggaaatat

SEQ ID NO: 6807 - DNA, 27 bp, Artificial Sequence
  Synthetic oligonucleotide
tagttattatattaatttggaaatatt

SEQ ID NO: 6808 - DNA, 27 bp, Artificial Sequence
  Synthetic oligonucleotide
agttattatattaatttggaaatatta

SEQ ID NO: 6809 - DNA, 27 bp, Artificial Sequence
  Synthetic oligonucleotide
gttattatattaatttggaaatattag

SEQ ID NO: 6810 - DNA, 27 bp, Artificial Sequence
  Synthetic oligonucleotide
ttattatattaatttggaaatattagg

SEQ ID NO: 6811 - DNA, 27 bp, Artificial Sequence
  Synthetic oligonucleotide
tattatattaatttggaaatattaggc

SEQ ID NO: 6812 - DNA, 27 bp, Artificial Sequence
  Synthetic oligonucleotide
attatattaatttggaaatattaggct

SEQ ID NO: 6813 - DNA, 27 bp, Artificial Sequence
  Synthetic oligonucleotide
ttatattaatttggaaatattaggcta

SEQ ID NO: 6814 - DNA, 27 bp, Artificial Sequence
  Synthetic oligonucleotide
tatattaatttggaaatattaggctat

SEQ ID NO: 6815 - DNA, 27 bp, Artificial Sequence
  Synthetic oligonucleotide
atattaatttggaaatattaggctatt

SEQ ID NO: 6816 - DNA, 27 bp, Artificial Sequence
  Synthetic oligonucleotide
tattaatttggaaatattaggctattc

SEQ ID NO: 6817 - DNA, 27 bp, Artificial Sequence
  Synthetic oligonucleotide
attaatttggaaatattaggctattct

SEQ ID NO: 6818 - DNA, 27 bp, Artificial Sequence
  Synthetic oligonucleotide
ttaatttggaaatattaggctattctt

SEQ ID NO: 6819 - DNA, 27 bp, Artificial Sequence
  Synthetic oligonucleotide
taatttggaaatattaggctattcttg

SEQ ID NO: 6820 - DNA, 27 bp, Artificial Sequence
  Synthetic oligonucleotide
aatttggaaatattaggctattcttgg

SEQ ID NO: 6821 - DNA, 27 bp, Artificial Sequence
  Synthetic oligonucleotide
atttggaaatattaggctattcttggg

SEQ ID NO: 6822 - DNA, 27 bp, Artificial Sequence
  Synthetic oligonucleotide
tttggaaatattaggctattcttgggc

SEQ ID NO: 6823 - DNA, 27 bp, Artificial Sequence
  Synthetic oligonucleotide
ttggaaatattaggctattcttgggca

SEQ ID NO: 6824 - DNA, 27 bp, Artificial Sequence
  Synthetic oligonucleotide
tggaaatattaggctattcttgggcaa

SEQ ID NO: 6825 - DNA, 27 bp, Artificial Sequence
  Synthetic oligonucleotide
ggaaatattaggctattcttgggcaac

SEQ ID NO: 6826 - DNA, 27 bp, Artificial Sequence
  Synthetic oligonucleotide
gaaatattaggctattcttgggcaacc

SEQ ID NO: 6827 - DNA, 27 bp, Artificial Sequence
  Synthetic oligonucleotide
aaatattaggctattcttgggcaaccc

SEQ ID NO: 6828 - DNA, 27 bp, Artificial Sequence
  Synthetic oligonucleotide
aatattaggctattcttgggcaaccct

SEQ ID NO: 6829 - DNA, 27 bp, Artificial Sequence
  Synthetic oligonucleotide
atattaggctattcttgggcaaccctg

SEQ ID NO: 6830 - DNA, 27 bp, Artificial Sequence
  Synthetic oligonucleotide
tattaggctattcttgggcaaccctgc

SEQ ID NO: 6831 - DNA, 27 bp, Artificial Sequence
  Synthetic oligonucleotide
attaggctattcttgggcaaccctgca

SEQ ID NO: 6832 - DNA, 27 bp, Artificial Sequence
  Synthetic oligonucleotide
ttaggctattcttgggcaaccctgcaa

SEQ ID NO: 6833 - DNA, 27 bp, Artificial Sequence
  Synthetic oligonucleotide
taggctattcttgggcaaccctgcaac

SEQ ID NO: 6834 - DNA, 27 bp, Artificial Sequence
  Synthetic oligonucleotide
aggctattcttgggcaaccctgcaacg

SEQ ID NO: 6835 - DNA, 27 bp, Artificial Sequence
  Synthetic oligonucleotide
ggctattcttgggcaaccctgcaacga

SEQ ID NO: 6836 - DNA, 27 bp, Artificial Sequence
  Synthetic oligonucleotide
gctattcttgggcaaccctgcaacgat

SEQ ID NO: 6837 - DNA, 27 bp, Artificial Sequence
  Synthetic oligonucleotide
ctattcttgggcaaccctgcaacgatt

SEQ ID NO: 6838 - DNA, 27 bp, Artificial Sequence
  Synthetic oligonucleotide
tattcttgggcaaccctgcaacgattt

SEQ ID NO: 6839 - DNA, 27 bp, Artificial Sequence
  Synthetic oligonucleotide
attcttgggcaaccctgcaacgatttt

SEQ ID NO: 6840 - DNA, 27 bp, Artificial Sequence
  Synthetic oligonucleotide
ttcttgggcaaccctgcaacgattttt

SEQ ID NO: 6841 - DNA, 27 bp, Artificial Sequence
  Synthetic oligonucleotide
tcttgggcaaccctgcaacgatttttt

SEQ ID NO: 6842 - DNA, 27 bp, Artificial Sequence
  Synthetic oligonucleotide
cttgggcaaccctgcaacgattttttc

SEQ ID NO: 6843 - DNA, 27 bp, Artificial Sequence
  Synthetic oligonucleotide
ttgggcaaccctgcaacgattttttct

SEQ ID NO: 6844 - DNA, 27 bp, Artificial Sequence
  Synthetic oligonucleotide
tgggcaaccctgcaacgattttttcta

SEQ ID NO: 6845 - DNA, 27 bp, Artificial Sequence
  Synthetic oligonucleotide
gggcaaccctgcaacgattttttctaa

SEQ ID NO: 6846 - DNA, 27 bp, Artificial Sequence
  Synthetic oligonucleotide
ggcaaccctgcaacgattttttctaac

SEQ ID NO: 6847 - DNA, 27 bp, Artificial Sequence
  Synthetic oligonucleotide
gcaaccctgcaacgattttttctaaca

SEQ ID NO: 6848 - DNA, 27 bp, Artificial Sequence
  Synthetic oligonucleotide
caaccctgcaacgattttttctaacag

SEQ ID NO: 6849 - DNA, 27 bp, Artificial Sequence
  Synthetic oligonucleotide
aaccctgcaacgattttttctaacagg

SEQ ID NO: 6850 - DNA, 27 bp, Artificial Sequence
  Synthetic oligonucleotide
accctgcaacgattttttctaacaggg

SEQ ID NO: 6851 - DNA, 27 bp, Artificial Sequence
  Synthetic oligonucleotide
ccctgcaacgattttttctaacaggga

SEQ ID NO: 6852 - DNA, 27 bp, Artificial Sequence
  Synthetic oligonucleotide
cctgcaacgattttttctaacagggat

SEQ ID NO: 6853 - DNA, 27 bp, Artificial Sequence
  Synthetic oligonucleotide
ctgcaacgattttttctaacagggata

SEQ ID NO: 6854 - DNA, 27 bp, Artificial Sequence
  Synthetic oligonucleotide
tgcaacgattttttctaacagggatat

SEQ ID NO: 6855 - DNA, 27 bp, Artificial Sequence
  Synthetic oligonucleotide
gcaacgattttttctaacagggatatt

SEQ ID NO: 6856 - DNA, 27 bp, Artificial Sequence
  Synthetic oligonucleotide
caacgattttttctaacagggatatta

SEQ ID NO: 6857 - DNA, 27 bp, Artificial Sequence
  Synthetic oligonucleotide
aacgattttttctaacagggatattat

SEQ ID NO: 6858 - DNA, 27 bp, Artificial Sequence
  Synthetic oligonucleotide
acgattttttctaacagggatattatt

SEQ ID NO: 6859 - DNA, 27 bp, Artificial Sequence
  Synthetic oligonucleotide
cgattttttctaacagggatattattg

SEQ ID NO: 6860 - DNA, 27 bp, Artificial Sequence
  Synthetic oligonucleotide
gattttttctaacagggatattattga

SEQ ID NO: 6861 - DNA, 27 bp, Artificial Sequence
  Synthetic oligonucleotide
attttttctaacagggatattattgac

SEQ ID NO: 6862 - DNA, 27 bp, Artificial Sequence
  Synthetic oligonucleotide
ttttttctaacagggatattattgact

SEQ ID NO: 6863 - DNA, 27 bp, Artificial Sequence
  Synthetic oligonucleotide
tttttctaacagggatattattgacta

SEQ ID NO: 6864 - DNA, 27 bp, Artificial Sequence
  Synthetic oligonucleotide
ttttctaacagggatattattgactaa

SEQ ID NO: 6865 - DNA, 27 bp, Artificial Sequence
  Synthetic oligonucleotide
tttctaacagggatattattgactaat

SEQ ID NO: 6866 - DNA, 27 bp, Artificial Sequence
  Synthetic oligonucleotide
ttctaacagggatattattgactaata

SEQ ID NO: 6867 - DNA, 27 bp, Artificial Sequence
  Synthetic oligonucleotide
tctaacagggatattattgactaatag

SEQ ID NO: 6868 - DNA, 27 bp, Artificial Sequence
  Synthetic oligonucleotide
ctaacagggatattattgactaatagc

SEQ ID NO: 6869 - DNA, 27 bp, Artificial Sequence
  Synthetic oligonucleotide
taacagggatattattgactaatagca

SEQ ID NO: 6870 - DNA, 27 bp, Artificial Sequence
  Synthetic oligonucleotide
aacagggatattattgactaatagcag

SEQ ID NO: 6871 - DNA, 27 bp, Artificial Sequence
  Synthetic oligonucleotide
acagggatattattgactaatagcaga

SEQ ID NO: 6872 - DNA, 27 bp, Artificial Sequence
  Synthetic oligonucleotide
cagggatattattgactaatagcagag

SEQ ID NO: 6873 - DNA, 27 bp, Artificial Sequence
  Synthetic oligonucleotide
agggatattattgactaatagcagagg

SEQ ID NO: 6874 - DNA, 27 bp, Artificial Sequence
  Synthetic oligonucleotide
gggatattattgactaatagcagagga

SEQ ID NO: 6875 - DNA, 27 bp, Artificial Sequence
  Synthetic oligonucleotide
ggatattattgactaatagcagaggat

SEQ ID NO: 6876 - DNA, 27 bp, Artificial Sequence
  Synthetic oligonucleotide
gatattattgactaatagcagaggatg

SEQ ID NO: 6877 - DNA, 27 bp, Artificial Sequence
  Synthetic oligonucleotide
atattattgactaatagcagaggatgt

SEQ ID NO: 6878 - DNA, 27 bp, Artificial Sequence
  Synthetic oligonucleotide
tattattgactaatagcagaggatgta

SEQ ID NO: 6879 - DNA, 27 bp, Artificial Sequence
  Synthetic oligonucleotide
attattgactaatagcagaggatgtaa

SEQ ID NO: 6880 - DNA, 27 bp, Artificial Sequence
  Synthetic oligonucleotide
ttattgactaatagcagaggatgtaat

SEQ ID NO: 6881 - DNA, 27 bp, Artificial Sequence
  Synthetic oligonucleotide
tattgactaatagcagaggatgtaata

SEQ ID NO: 6882 - DNA, 27 bp, Artificial Sequence
  Synthetic oligonucleotide
attgactaatagcagaggatgtaatag

SEQ ID NO: 6883 - DNA, 27 bp, Artificial Sequence
  Synthetic oligonucleotide
ttgactaatagcagaggatgtaatagt

SEQ ID NO: 6884 - DNA, 27 bp, Artificial Sequence
  Synthetic oligonucleotide
tgactaatagcagaggatgtaatagtc

SEQ ID NO: 6885 - DNA, 27 bp, Artificial Sequence
  Synthetic oligonucleotide
gactaatagcagaggatgtaatagtca

SEQ ID NO: 6886 - DNA, 27 bp, Artificial Sequence
  Synthetic oligonucleotide
actaatagcagaggatgtaatagtcaa

SEQ ID NO: 6887 - DNA, 27 bp, Artificial Sequence
  Synthetic oligonucleotide
ctaatagcagaggatgtaatagtcaac

SEQ ID NO: 6888 - DNA, 27 bp, Artificial Sequence
  Synthetic oligonucleotide
taatagcagaggatgtaatagtcaact

SEQ ID NO: 6889 - DNA, 27 bp, Artificial Sequence
  Synthetic oligonucleotide
aatagcagaggatgtaatagtcaactg

SEQ ID NO: 6890 - DNA, 27 bp, Artificial Sequence
  Synthetic oligonucleotide
atagcagaggatgtaatagtcaactga

SEQ ID NO: 6891 - DNA, 27 bp, Artificial Sequence
  Synthetic oligonucleotide
tagcagaggatgtaatagtcaactgag

SEQ ID NO: 6892 - DNA, 27 bp, Artificial Sequence
  Synthetic oligonucleotide
agcagaggatgtaatagtcaactgagt

SEQ ID NO: 6893 - DNA, 27 bp, Artificial Sequence
  Synthetic oligonucleotide
gcagaggatgtaatagtcaactgagtt

SEQ ID NO: 6894 - DNA, 27 bp, Artificial Sequence
  Synthetic oligonucleotide
cagaggatgtaatagtcaactgagttg

SEQ ID NO: 6895 - DNA, 27 bp, Artificial Sequence
  Synthetic oligonucleotide
agaggatgtaatagtcaactgagttgt

SEQ ID NO: 6896 - DNA, 27 bp, Artificial Sequence
  Synthetic oligonucleotide
gaggatgtaatagtcaactgagttgta

SEQ ID NO: 6897 - DNA, 27 bp, Artificial Sequence
  Synthetic oligonucleotide
aggatgtaatagtcaactgagttgtat

SEQ ID NO: 6898 - DNA, 27 bp, Artificial Sequence
  Synthetic oligonucleotide
ggatgtaatagtcaactgagttgtatt

SEQ ID NO: 6899 - DNA, 27 bp, Artificial Sequence
  Synthetic oligonucleotide
gatgtaatagtcaactgagttgtattg

SEQ ID NO: 6900 - DNA, 27 bp, Artificial Sequence
  Synthetic oligonucleotide
atgtaatagtcaactgagttgtattgg

SEQ ID NO: 6901 - DNA, 27 bp, Artificial Sequence
  Synthetic oligonucleotide
tgtaatagtcaactgagttgtattggt

SEQ ID NO: 6902 - DNA, 27 bp, Artificial Sequence
  Synthetic oligonucleotide
gtaatagtcaactgagttgtattggta

SEQ ID NO: 6903 - DNA, 27 bp, Artificial Sequence
  Synthetic oligonucleotide
taatagtcaactgagttgtattggtac

SEQ ID NO: 6904 - DNA, 27 bp, Artificial Sequence
  Synthetic oligonucleotide
aatagtcaactgagttgtattggtacc

SEQ ID NO: 6905 - DNA, 27 bp, Artificial Sequence
  Synthetic oligonucleotide
atagtcaactgagttgtattggtacca

SEQ ID NO: 6906 - DNA, 27 bp, Artificial Sequence
  Synthetic oligonucleotide
tagtcaactgagttgtattggtaccac

SEQ ID NO: 6907 - DNA, 27 bp, Artificial Sequence
  Synthetic oligonucleotide
agtcaactgagttgtattggtaccact

SEQ ID NO: 6908 - DNA, 27 bp, Artificial Sequence
  Synthetic oligonucleotide
gtcaactgagttgtattggtaccactt

SEQ ID NO: 6909 - DNA, 27 bp, Artificial Sequence
  Synthetic oligonucleotide
tcaactgagttgtattggtaccacttc

SEQ ID NO: 6910 - DNA, 27 bp, Artificial Sequence
  Synthetic oligonucleotide
caactgagttgtattggtaccacttcc

SEQ ID NO: 6911 - DNA, 27 bp, Artificial Sequence
  Synthetic oligonucleotide
aactgagttgtattggtaccacttcca

SEQ ID NO: 6912 - DNA, 27 bp, Artificial Sequence
  Synthetic oligonucleotide
actgagttgtattggtaccacttccat

SEQ ID NO: 6913 - DNA, 27 bp, Artificial Sequence
  Synthetic oligonucleotide
ctgagttgtattggtaccacttccatt

SEQ ID NO: 6914 - DNA, 27 bp, Artificial Sequence
  Synthetic oligonucleotide
tgagttgtattggtaccacttccattg

SEQ ID NO: 6915 - DNA, 27 bp, Artificial Sequence
  Synthetic oligonucleotide
gagttgtattggtaccacttccattgt

SEQ ID NO: 6916 - DNA, 27 bp, Artificial Sequence
  Synthetic oligonucleotide
agttgtattggtaccacttccattgta

SEQ ID NO: 6917 - DNA, 27 bp, Artificial Sequence
  Synthetic oligonucleotide
gttgtattggtaccacttccattgtaa

SEQ ID NO: 6918 - DNA, 27 bp, Artificial Sequence
  Synthetic oligonucleotide
ttgtattggtaccacttccattgtaag

SEQ ID NO: 6919 - DNA, 27 bp, Artificial Sequence
  Synthetic oligonucleotide
tgtattggtaccacttccattgtaagt

SEQ ID NO: 6920 - DNA, 27 bp, Artificial Sequence
  Synthetic oligonucleotide
gtattggtaccacttccattgtaagtc

SEQ ID NO: 6921 - DNA, 27 bp, Artificial Sequence
  Synthetic oligonucleotide
tattggtaccacttccattgtaagtcc

SEQ ID NO: 6922 - DNA, 27 bp, Artificial Sequence
  Synthetic oligonucleotide
attggtaccacttccattgtaagtccc

SEQ ID NO: 6923 - DNA, 27 bp, Artificial Sequence
  Synthetic oligonucleotide
ttggtaccacttccattgtaagtccca

SEQ ID NO: 6924 - DNA, 27 bp, Artificial Sequence
  Synthetic oligonucleotide
tggtaccacttccattgtaagtcccaa

SEQ ID NO: 6925 - DNA, 27 bp, Artificial Sequence
  Synthetic oligonucleotide
ggtaccacttccattgtaagtcccaaa

SEQ ID NO: 6926 - DNA, 27 bp, Artificial Sequence
  Synthetic oligonucleotide
gtaccacttccattgtaagtcccaaag

SEQ ID NO: 6927 - DNA, 27 bp, Artificial Sequence
  Synthetic oligonucleotide
taccacttccattgtaagtcccaaagt

SEQ ID NO: 6928 - DNA, 27 bp, Artificial Sequence
  Synthetic oligonucleotide
accacttccattgtaagtcccaaagta

SEQ ID NO: 6929 - DNA, 27 bp, Artificial Sequence
  Synthetic oligonucleotide
ccacttccattgtaagtcccaaagtat

SEQ ID NO: 6930 - DNA, 27 bp, Artificial Sequence
  Synthetic oligonucleotide
cacttccattgtaagtcccaaagtatt

SEQ ID NO: 6931 - DNA, 27 bp, Artificial Sequence
  Synthetic oligonucleotide
acttccattgtaagtcccaaagtatta

SEQ ID NO: 6932 - DNA, 27 bp, Artificial Sequence
  Synthetic oligonucleotide
cttccattgtaagtcccaaagtattat

SEQ ID NO: 6933 - DNA, 27 bp, Artificial Sequence
  Synthetic oligonucleotide
ttccattgtaagtcccaaagtattata

SEQ ID NO: 6934 - DNA, 27 bp, Artificial Sequence
  Synthetic oligonucleotide
tccattgtaagtcccaaagtattatat

SEQ ID NO: 6935 - DNA, 27 bp, Artificial Sequence
  Synthetic oligonucleotide
ccattgtaagtcccaaagtattatata

SEQ ID NO: 6936 - DNA, 27 bp, Artificial Sequence
  Synthetic oligonucleotide
cattgtaagtcccaaagtattatatat

SEQ ID NO: 6937 - DNA, 27 bp, Artificial Sequence
  Synthetic oligonucleotide
attgtaagtcccaaagtattatatatt

SEQ ID NO: 6938 - DNA, 27 bp, Artificial Sequence
  Synthetic oligonucleotide
ttgtaagtcccaaagtattatatattt

SEQ ID NO: 6939 - DNA, 27 bp, Artificial Sequence
  Synthetic oligonucleotide
tgtaagtcccaaagtattatatatttg

SEQ ID NO: 6940 - DNA, 27 bp, Artificial Sequence
  Synthetic oligonucleotide
gtaagtcccaaagtattatatatttga

SEQ ID NO: 6941 - DNA, 27 bp, Artificial Sequence
  Synthetic oligonucleotide
taagtcccaaagtattatatatttgat

SEQ ID NO: 6942 - DNA, 27 bp, Artificial Sequence
  Synthetic oligonucleotide
aagtcccaaagtattatatatttgata

SEQ ID NO: 6943 - DNA, 27 bp, Artificial Sequence
  Synthetic oligonucleotide
agtcccaaagtattatatatttgataa

SEQ ID NO: 6944 - DNA, 27 bp, Artificial Sequence
  Synthetic oligonucleotide
gtcccaaagtattatatatttgataat

SEQ ID NO: 6945 - DNA, 27 bp, Artificial Sequence
  Synthetic oligonucleotide
tcccaaagtattatatatttgataata

SEQ ID NO: 6946 - DNA, 27 bp, Artificial Sequence
  Synthetic oligonucleotide
cccaaagtattatatatttgataataa

SEQ ID NO: 6947 - DNA, 27 bp, Artificial Sequence
  Synthetic oligonucleotide
ccaaagtattatatatttgataataat

SEQ ID NO: 6948 - DNA, 27 bp, Artificial Sequence
  Synthetic oligonucleotide
caaagtattatatatttgataataatg

SEQ ID NO: 6949 - DNA, 27 bp, Artificial Sequence
  Synthetic oligonucleotide
aaagtattatatatttgataataatgc

SEQ ID NO: 6950 - DNA, 27 bp, Artificial Sequence
  Synthetic oligonucleotide
aagtattatatatttgataataatgct

SEQ ID NO: 6951 - DNA, 27 bp, Artificial Sequence
  Synthetic oligonucleotide
agtattatatatttgataataatgcta

SEQ ID NO: 6952 - DNA, 27 bp, Artificial Sequence
  Synthetic oligonucleotide
gtattatatatttgataataatgctaa

SEQ ID NO: 6953 - DNA, 27 bp, Artificial Sequence
  Synthetic oligonucleotide
tattatatatttgataataatgctaat

SEQ ID NO: 6954 - DNA, 27 bp, Artificial Sequence
  Synthetic oligonucleotide
attatatatttgataataatgctaatc

SEQ ID NO: 6955 - DNA, 27 bp, Artificial Sequence
  Synthetic oligonucleotide
ttatatatttgataataatgctaatca

SEQ ID NO: 6956 - DNA, 27 bp, Artificial Sequence
  Synthetic oligonucleotide
tatatatttgataataatgctaatcat

SEQ ID NO: 6957 - DNA, 27 bp, Artificial Sequence
  Synthetic oligonucleotide
atatatttgataataatgctaatcata

SEQ ID NO: 6958 - DNA, 27 bp, Artificial Sequence
  Synthetic oligonucleotide
tatatttgataataatgctaatcataa

SEQ ID NO: 6959 - DNA, 27 bp, Artificial Sequence
  Synthetic oligonucleotide
atatttgataataatgctaatcataat

SEQ ID NO: 6960 - DNA, 27 bp, Artificial Sequence
  Synthetic oligonucleotide
tatttgataataatgctaatcataatt

SEQ ID NO: 6961 - DNA, 27 bp, Artificial Sequence
  Synthetic oligonucleotide
atttgataataatgctaatcataattg

SEQ ID NO: 6962 - DNA, 27 bp, Artificial Sequence
  Synthetic oligonucleotide
tttgataataatgctaatcataattgg

SEQ ID NO: 6963 - DNA, 27 bp, Artificial Sequence
  Synthetic oligonucleotide
ttgataataatgctaatcataattgga

SEQ ID NO: 6964 - DNA, 27 bp, Artificial Sequence
  Synthetic oligonucleotide
tgataataatgctaatcataattggaa

SEQ ID NO: 6965 - DNA, 27 bp, Artificial Sequence
  Synthetic oligonucleotide
gataataatgctaatcataattggaaa

SEQ ID NO: 6966 - DNA, 27 bp, Artificial Sequence
  Synthetic oligonucleotide
ataataatgctaatcataattggaaag

SEQ ID NO: 6967 - DNA, 27 bp, Artificial Sequence
  Synthetic oligonucleotide
taataatgctaatcataattggaaagt

SEQ ID NO: 6968 - DNA, 27 bp, Artificial Sequence
  Synthetic oligonucleotide
aataatgctaatcataattggaaagta

SEQ ID NO: 6969 - DNA, 27 bp, Artificial Sequence
  Synthetic oligonucleotide
ataatgctaatcataattggaaagtaa

SEQ ID NO: 6970 - DNA, 27 bp, Artificial Sequence
  Synthetic oligonucleotide
taatgctaatcataattggaaagtaac

SEQ ID NO: 6971 - DNA, 27 bp, Artificial Sequence
  Synthetic oligonucleotide
aatgctaatcataattggaaagtaaca

SEQ ID NO: 6972 - DNA, 27 bp, Artificial Sequence
  Synthetic oligonucleotide
atgctaatcataattggaaagtaacat

SEQ ID NO: 6973 - DNA, 27 bp, Artificial Sequence
  Synthetic oligonucleotide
tgctaatcataattggaaagtaacatt

SEQ ID NO: 6974 - DNA, 27 bp, Artificial Sequence
  Synthetic oligonucleotide
gctaatcataattggaaagtaacattc

SEQ ID NO: 6975 - DNA, 27 bp, Artificial Sequence
  Synthetic oligonucleotide
ctaatcataattggaaagtaacattct

SEQ ID NO: 6976 - DNA, 27 bp, Artificial Sequence
  Synthetic oligonucleotide
taatcataattggaaagtaacattcta

SEQ ID NO: 6977 - DNA, 27 bp, Artificial Sequence
  Synthetic oligonucleotide
aatcataattggaaagtaacattctat

SEQ ID NO: 6978 - DNA, 27 bp, Artificial Sequence
  Synthetic oligonucleotide
atcataattggaaagtaacattctata

SEQ ID NO: 6979 - DNA, 27 bp, Artificial Sequence
  Synthetic oligonucleotide
tcataattggaaagtaacattctatat

SEQ ID NO: 6980 - DNA, 27 bp, Artificial Sequence
  Synthetic oligonucleotide
cataattggaaagtaacattctatatg

SEQ ID NO: 6981 - DNA, 27 bp, Artificial Sequence
  Synthetic oligonucleotide
ataattggaaagtaacattctatatgt

SEQ ID NO: 6982 - DNA, 27 bp, Artificial Sequence
  Synthetic oligonucleotide
taattggaaagtaacattctatatgta

SEQ ID NO: 6983 - DNA, 27 bp, Artificial Sequence
  Synthetic oligonucleotide
aattggaaagtaacattctatatgtaa

SEQ ID NO: 6984 - DNA, 27 bp, Artificial Sequence
  Synthetic oligonucleotide
attggaaagtaacattctatatgtaaa

SEQ ID NO: 6985 - DNA, 27 bp, Artificial Sequence
  Synthetic oligonucleotide
ttggaaagtaacattctatatgtaaat

SEQ ID NO: 6986 - DNA, 27 bp, Artificial Sequence
  Synthetic oligonucleotide
tggaaagtaacattctatatgtaaatg

SEQ ID NO: 6987 - DNA, 27 bp, Artificial Sequence
  Synthetic oligonucleotide
ggaaagtaacattctatatgtaaatgt

SEQ ID NO: 6988 - DNA, 27 bp, Artificial Sequence
  Synthetic oligonucleotide
gaaagtaacattctatatgtaaatgta

SEQ ID NO: 6989 - DNA, 27 bp, Artificial Sequence
  Synthetic oligonucleotide
aaagtaacattctatatgtaaatgtaa

SEQ ID NO: 6990 - DNA, 27 bp, Artificial Sequence
  Synthetic oligonucleotide
aagtaacattctatatgtaaatgtaaa

SEQ ID NO: 6991 - DNA, 27 bp, Artificial Sequence
  Synthetic oligonucleotide
agtaacattctatatgtaaatgtaaaa

SEQ ID NO: 6992 - DNA, 27 bp, Artificial Sequence
  Synthetic oligonucleotide
gtaacattctatatgtaaatgtaaaat

SEQ ID NO: 6993 - DNA, 27 bp, Artificial Sequence
  Synthetic oligonucleotide
taacattctatatgtaaatgtaaaatt

SEQ ID NO: 6994 - DNA, 27 bp, Artificial Sequence
  Synthetic oligonucleotide
aacattctatatgtaaatgtaaaattt

SEQ ID NO: 6995 - DNA, 27 bp, Artificial Sequence
  Synthetic oligonucleotide
acattctatatgtaaatgtaaaattta

SEQ ID NO: 6996 - DNA, 27 bp, Artificial Sequence
  Synthetic oligonucleotide
cattctatatgtaaatgtaaaatttat

SEQ ID NO: 6997 - DNA, 27 bp, Artificial Sequence
  Synthetic oligonucleotide
attctatatgtaaatgtaaaatttatt

SEQ ID NO: 6998 - DNA, 27 bp, Artificial Sequence
  Synthetic oligonucleotide
ttctatatgtaaatgtaaaatttattt

SEQ ID NO: 6999 - DNA, 27 bp, Artificial Sequence
  Synthetic oligonucleotide
tctatatgtaaatgtaaaatttatttg

SEQ ID NO: 7000 - DNA, 27 bp, Artificial Sequence
  Synthetic oligonucleotide
ctatatgtaaatgtaaaatttatttgc

SEQ ID NO: 7001 - DNA, 27 bp, Artificial Sequence
  Synthetic oligonucleotide
tatatgtaaatgtaaaatttatttgcc

SEQ ID NO: 7002 - DNA, 27 bp, Artificial Sequence
  Synthetic oligonucleotide
atatgtaaatgtaaaatttatttgcca

SEQ ID NO: 7003 - DNA, 27 bp, Artificial Sequence
  Synthetic oligonucleotide
tatgtaaatgtaaaatttatttgccaa

SEQ ID NO: 7004 - DNA, 27 bp, Artificial Sequence
  Synthetic oligonucleotide
atgtaaatgtaaaatttatttgccaac

SEQ ID NO: 7005 - DNA, 27 bp, Artificial Sequence
  Synthetic oligonucleotide
tgtaaatgtaaaatttatttgccaact

SEQ ID NO: 7006 - DNA, 27 bp, Artificial Sequence
  Synthetic oligonucleotide
gtaaatgtaaaatttatttgccaactg

SEQ ID NO: 7007 - DNA, 27 bp, Artificial Sequence
  Synthetic oligonucleotide
taaatgtaaaatttatttgccaactga

SEQ ID NO: 7008 - DNA, 27 bp, Artificial Sequence
  Synthetic oligonucleotide
aaatgtaaaatttatttgccaactgaa

SEQ ID NO: 7009 - DNA, 27 bp, Artificial Sequence
  Synthetic oligonucleotide
aatgtaaaatttatttgccaactgaat

SEQ ID NO: 7010 - DNA, 27 bp, Artificial Sequence
  Synthetic oligonucleotide
atgtaaaatttatttgccaactgaata

SEQ ID NO: 7011 - DNA, 27 bp, Artificial Sequence
  Synthetic oligonucleotide
tgtaaaatttatttgccaactgaatat

SEQ ID NO: 7012 - DNA, 27 bp, Artificial Sequence
  Synthetic oligonucleotide
gtaaaatttatttgccaactgaatata

SEQ ID NO: 7013 - DNA, 27 bp, Artificial Sequence
  Synthetic oligonucleotide
taaaatttatttgccaactgaatatag

SEQ ID NO: 7014 - DNA, 27 bp, Artificial Sequence
  Synthetic oligonucleotide
aaaatttatttgccaactgaatatagg

SEQ ID NO: 7015 - DNA, 27 bp, Artificial Sequence
  Synthetic oligonucleotide
aaatttatttgccaactgaatataggc

SEQ ID NO: 7016 - DNA, 27 bp, Artificial Sequence
  Synthetic oligonucleotide
aatttatttgccaactgaatataggca

SEQ ID NO: 7017 - DNA, 27 bp, Artificial Sequence
  Synthetic oligonucleotide
atttatttgccaactgaatataggcaa

SEQ ID NO: 7018 - DNA, 27 bp, Artificial Sequence
  Synthetic oligonucleotide
tttatttgccaactgaatataggcaat

SEQ ID NO: 7019 - DNA, 27 bp, Artificial Sequence
  Synthetic oligonucleotide
ttatttgccaactgaatataggcaatg

SEQ ID NO: 7020 - DNA, 27 bp, Artificial Sequence
  Synthetic oligonucleotide
tatttgccaactgaatataggcaatga

SEQ ID NO: 7021 - DNA, 27 bp, Artificial Sequence
  Synthetic oligonucleotide
atttgccaactgaatataggcaatgat

SEQ ID NO: 7022 - DNA, 27 bp, Artificial Sequence
  Synthetic oligonucleotide
tttgccaactgaatataggcaatgata

SEQ ID NO: 7023 - DNA, 27 bp, Artificial Sequence
  Synthetic oligonucleotide
ttgccaactgaatataggcaatgatag

SEQ ID NO: 7024 - DNA, 27 bp, Artificial Sequence
  Synthetic oligonucleotide
tgccaactgaatataggcaatgatagt

SEQ ID NO: 7025 - DNA, 27 bp, Artificial Sequence
  Synthetic oligonucleotide
gccaactgaatataggcaatgatagtg

SEQ ID NO: 7026 - DNA, 27 bp, Artificial Sequence
  Synthetic oligonucleotide
ccaactgaatataggcaatgatagtgt

SEQ ID NO: 7027 - DNA, 27 bp, Artificial Sequence
  Synthetic oligonucleotide
caactgaatataggcaatgatagtgtg

SEQ ID NO: 7028 - DNA, 27 bp, Artificial Sequence
  Synthetic oligonucleotide
aactgaatataggcaatgatagtgtgt

SEQ ID NO: 7029 - DNA, 27 bp, Artificial Sequence
  Synthetic oligonucleotide
actgaatataggcaatgatagtgtgtc

SEQ ID NO: 7030 - DNA, 27 bp, Artificial Sequence
  Synthetic oligonucleotide
ctgaatataggcaatgatagtgtgtca

SEQ ID NO: 7031 - DNA, 27 bp, Artificial Sequence
  Synthetic oligonucleotide
tgaatataggcaatgatagtgtgtcac

SEQ ID NO: 7032 - DNA, 27 bp, Artificial Sequence
  Synthetic oligonucleotide
gaatataggcaatgatagtgtgtcact

SEQ ID NO: 7033 - DNA, 27 bp, Artificial Sequence
  Synthetic oligonucleotide
aatataggcaatgatagtgtgtcacta

SEQ ID NO: 7034 - DNA, 27 bp, Artificial Sequence
  Synthetic oligonucleotide
atataggcaatgatagtgtgtcactat

SEQ ID NO: 7035 - DNA, 27 bp, Artificial Sequence
  Synthetic oligonucleotide
tataggcaatgatagtgtgtcactata

SEQ ID NO: 7036 - DNA, 27 bp, Artificial Sequence
  Synthetic oligonucleotide
ataggcaatgatagtgtgtcactatag

SEQ ID NO: 7037 - DNA, 27 bp, Artificial Sequence
  Synthetic oligonucleotide
taggcaatgatagtgtgtcactatagg

SEQ ID NO: 7038 - DNA, 27 bp, Artificial Sequence
  Synthetic oligonucleotide
aggcaatgatagtgtgtcactataggg

SEQ ID NO: 7039 - DNA, 27 bp, Artificial Sequence
  Synthetic oligonucleotide
ggcaatgatagtgtgtcactataggga

SEQ ID NO: 7040 - DNA, 27 bp, Artificial Sequence
  Synthetic oligonucleotide
gcaatgatagtgtgtcactatagggaa

SEQ ID NO: 7041 - DNA, 27 bp, Artificial Sequence
  Synthetic oligonucleotide
caatgatagtgtgtcactatagggaac

SEQ ID NO: 7042 - DNA, 27 bp, Artificial Sequence
  Synthetic oligonucleotide
aatgatagtgtgtcactatagggaaca

SEQ ID NO: 7043 - DNA, 27 bp, Artificial Sequence
  Synthetic oligonucleotide
atgatagtgtgtcactatagggaacac

SEQ ID NO: 7044 - DNA, 27 bp, Artificial Sequence
  Synthetic oligonucleotide
tgatagtgtgtcactatagggaacaca

SEQ ID NO: 7045 - DNA, 27 bp, Artificial Sequence
  Synthetic oligonucleotide
gatagtgtgtcactatagggaacacag

SEQ ID NO: 7046 - DNA, 27 bp, Artificial Sequence
  Synthetic oligonucleotide
atagtgtgtcactatagggaacacaga

SEQ ID NO: 7047 - DNA, 27 bp, Artificial Sequence
  Synthetic oligonucleotide
tagtgtgtcactatagggaacacagat

SEQ ID NO: 7048 - DNA, 27 bp, Artificial Sequence
  Synthetic oligonucleotide
agtgtgtcactatagggaacacagatt

SEQ ID NO: 7049 - DNA, 27 bp, Artificial Sequence
  Synthetic oligonucleotide
gtgtgtcactatagggaacacagattt

SEQ ID NO: 7050 - DNA, 27 bp, Artificial Sequence
  Synthetic oligonucleotide
tgtgtcactatagggaacacagatttt

SEQ ID NO: 7051 - DNA, 27 bp, Artificial Sequence
  Synthetic oligonucleotide
gtgtcactatagggaacacagattttt

SEQ ID NO: 7052 - DNA, 27 bp, Artificial Sequence
  Synthetic oligonucleotide
tgtcactatagggaacacagatttttg

SEQ ID NO: 7053 - DNA, 27 bp, Artificial Sequence
  Synthetic oligonucleotide
gtcactatagggaacacagatttttga

SEQ ID NO: 7054 - DNA, 27 bp, Artificial Sequence
  Synthetic oligonucleotide
tcactatagggaacacagatttttgag

SEQ ID NO: 7055 - DNA, 27 bp, Artificial Sequence
  Synthetic oligonucleotide
cactatagggaacacagatttttgaga

SEQ ID NO: 7056 - DNA, 27 bp, Artificial Sequence
  Synthetic oligonucleotide
actatagggaacacagatttttgagat

SEQ ID NO: 7057 - DNA, 27 bp, Artificial Sequence
  Synthetic oligonucleotide
ctatagggaacacagatttttgagatc

SEQ ID NO: 7058 - DNA, 27 bp, Artificial Sequence
  Synthetic oligonucleotide
tatagggaacacagatttttgagatct

SEQ ID NO: 7059 - DNA, 27 bp, Artificial Sequence
  Synthetic oligonucleotide
atagggaacacagatttttgagatctt

SEQ ID NO: 7060 - DNA, 27 bp, Artificial Sequence
  Synthetic oligonucleotide
tagggaacacagatttttgagatcttg

SEQ ID NO: 7061 - DNA, 27 bp, Artificial Sequence
  Synthetic oligonucleotide
agggaacacagatttttgagatcttgt

SEQ ID NO: 7062 - DNA, 27 bp, Artificial Sequence
  Synthetic oligonucleotide
gggaacacagatttttgagatcttgtc

SEQ ID NO: 7063 - DNA, 27 bp, Artificial Sequence
  Synthetic oligonucleotide
ggaacacagatttttgagatcttgtcc

SEQ ID NO: 7064 - DNA, 27 bp, Artificial Sequence
  Synthetic oligonucleotide
gaacacagatttttgagatcttgtcct

SEQ ID NO: 7065 - DNA, 27 bp, Artificial Sequence
  Synthetic oligonucleotide
aacacagatttttgagatcttgtcctc

SEQ ID NO: 7066 - DNA, 27 bp, Artificial Sequence
  Synthetic oligonucleotide
acacagatttttgagatcttgtcctct

SEQ ID NO: 7067 - DNA, 27 bp, Artificial Sequence
  Synthetic oligonucleotide
cacagatttttgagatcttgtcctctg

SEQ ID NO: 7068 - DNA, 27 bp, Artificial Sequence
  Synthetic oligonucleotide
acagatttttgagatcttgtcctctgg

SEQ ID NO: 7069 - DNA, 27 bp, Artificial Sequence
  Synthetic oligonucleotide
cagatttttgagatcttgtcctctgga

SEQ ID NO: 7070 - DNA, 27 bp, Artificial Sequence
  Synthetic oligonucleotide
agatttttgagatcttgtcctctggaa

SEQ ID NO: 7071 - DNA, 27 bp, Artificial Sequence
  Synthetic oligonucleotide
gatttttgagatcttgtcctctggaag

SEQ ID NO: 7072 - DNA, 27 bp, Artificial Sequence
  Synthetic oligonucleotide
atttttgagatcttgtcctctggaagc

SEQ ID NO: 7073 - DNA, 27 bp, Artificial Sequence
  Synthetic oligonucleotide
tttttgagatcttgtcctctggaagct

SEQ ID NO: 7074 - DNA, 27 bp, Artificial Sequence
  Synthetic oligonucleotide
ttttgagatcttgtcctctggaagctg

SEQ ID NO: 7075 - DNA, 27 bp, Artificial Sequence
  Synthetic oligonucleotide
tttgagatcttgtcctctggaagctgg

SEQ ID NO: 7076 - DNA, 27 bp, Artificial Sequence
  Synthetic oligonucleotide
ttgagatcttgtcctctggaagctggt

SEQ ID NO: 7077 - DNA, 27 bp, Artificial Sequence
  Synthetic oligonucleotide
tgagatcttgtcctctggaagctggta

SEQ ID NO: 7078 - DNA, 27 bp, Artificial Sequence
  Synthetic oligonucleotide
gagatcttgtcctctggaagctggtaa

SEQ ID NO: 7079 - DNA, 27 bp, Artificial Sequence
  Synthetic oligonucleotide
agatcttgtcctctggaagctggtaac

SEQ ID NO: 7080 - DNA, 27 bp, Artificial Sequence
  Synthetic oligonucleotide
gatcttgtcctctggaagctggtaaca

SEQ ID NO: 7081 - DNA, 27 bp, Artificial Sequence
  Synthetic oligonucleotide
atcttgtcctctggaagctggtaacaa

SEQ ID NO: 7082 - DNA, 27 bp, Artificial Sequence
  Synthetic oligonucleotide
tcttgtcctctggaagctggtaacaat

SEQ ID NO: 7083 - DNA, 27 bp, Artificial Sequence
  Synthetic oligonucleotide
cttgtcctctggaagctggtaacaatt

SEQ ID NO: 7084 - DNA, 27 bp, Artificial Sequence
  Synthetic oligonucleotide
ttgtcctctggaagctggtaacaatta

SEQ ID NO: 7085 - DNA, 27 bp, Artificial Sequence
  Synthetic oligonucleotide
tgtcctctggaagctggtaacaattaa

SEQ ID NO: 7086 - DNA, 27 bp, Artificial Sequence
  Synthetic oligonucleotide
gtcctctggaagctggtaacaattaaa

SEQ ID NO: 7087 - DNA, 27 bp, Artificial Sequence
  Synthetic oligonucleotide
tcctctggaagctggtaacaattaaaa

SEQ ID NO: 7088 - DNA, 27 bp, Artificial Sequence
  Synthetic oligonucleotide
cctctggaagctggtaacaattaaaaa

SEQ ID NO: 7089 - DNA, 27 bp, Artificial Sequence
  Synthetic oligonucleotide
ctctggaagctggtaacaattaaaaac

SEQ ID NO: 7090 - DNA, 27 bp, Artificial Sequence
  Synthetic oligonucleotide
tctggaagctggtaacaattaaaaaca

SEQ ID NO: 7091 - DNA, 27 bp, Artificial Sequence
  Synthetic oligonucleotide
ctggaagctggtaacaattaaaaacaa

SEQ ID NO: 7092 - DNA, 27 bp, Artificial Sequence
  Synthetic oligonucleotide
tggaagctggtaacaattaaaaacaat

SEQ ID NO: 7093 - DNA, 27 bp, Artificial Sequence
  Synthetic oligonucleotide
ggaagctggtaacaattaaaaacaatc

SEQ ID NO: 7094 - DNA, 27 bp, Artificial Sequence
  Synthetic oligonucleotide
gaagctggtaacaattaaaaacaatct

SEQ ID NO: 7095 - DNA, 27 bp, Artificial Sequence
  Synthetic oligonucleotide
aagctggtaacaattaaaaacaatctt

SEQ ID NO: 7096 - DNA, 27 bp, Artificial Sequence
  Synthetic oligonucleotide
agctggtaacaattaaaaacaatctta

SEQ ID NO: 7097 - DNA, 27 bp, Artificial Sequence
  Synthetic oligonucleotide
gctggtaacaattaaaaacaatcttaa

SEQ ID NO: 7098 - DNA, 27 bp, Artificial Sequence
  Synthetic oligonucleotide
ctggtaacaattaaaaacaatcttaag

SEQ ID NO: 7099 - DNA, 27 bp, Artificial Sequence
  Synthetic oligonucleotide
tggtaacaattaaaaacaatcttaagg

SEQ ID NO: 7100 - DNA, 27 bp, Artificial Sequence
  Synthetic oligonucleotide
ggtaacaattaaaaacaatcttaaggc

SEQ ID NO: 7101 - DNA, 27 bp, Artificial Sequence
  Synthetic oligonucleotide
gtaacaattaaaaacaatcttaaggca

SEQ ID NO: 7102 - DNA, 27 bp, Artificial Sequence
  Synthetic oligonucleotide
taacaattaaaaacaatcttaaggcag

SEQ ID NO: 7103 - DNA, 27 bp, Artificial Sequence
  Synthetic oligonucleotide
aacaattaaaaacaatcttaaggcagg

SEQ ID NO: 7104 - DNA, 27 bp, Artificial Sequence
  Synthetic oligonucleotide
acaattaaaaacaatcttaaggcaggg

SEQ ID NO: 7105 - DNA, 27 bp, Artificial Sequence
  Synthetic oligonucleotide
caattaaaaacaatcttaaggcaggga

SEQ ID NO: 7106 - DNA, 27 bp, Artificial Sequence
  Synthetic oligonucleotide
aattaaaaacaatcttaaggcagggaa

SEQ ID NO: 7107 - DNA, 27 bp, Artificial Sequence
  Synthetic oligonucleotide
attaaaaacaatcttaaggcagggaaa

SEQ ID NO: 7108 - DNA, 27 bp, Artificial Sequence
  Synthetic oligonucleotide
ttaaaaacaatcttaaggcagggaaaa

SEQ ID NO: 7109 - DNA, 27 bp, Artificial Sequence
  Synthetic oligonucleotide
taaaaacaatcttaaggcagggaaaaa

SEQ ID NO: 7110 - DNA, 27 bp, Artificial Sequence
  Synthetic oligonucleotide
aaaaacaatcttaaggcagggaaaaaa

SEQ ID NO: 7111 - DNA, 27 bp, Artificial Sequence
  Synthetic oligonucleotide
aaaacaatcttaaggcagggaaaaaaa

SEQ ID NO: 7112 - DNA, 27 bp, Artificial Sequence
  Synthetic oligonucleotide
aaacaatcttaaggcagggaaaaaaaa

SEQ ID NO: 7113 - DNA, 27 bp, Artificial Sequence
  Synthetic oligonucleotide
aacaatcttaaggcagggaaaaaaaaa

SEQ ID NO: 7114 - DNA, 27 bp, Artificial Sequence
  Synthetic oligonucleotide
acaatcttaaggcagggaaaaaaaaaa

SEQ ID NO: 7115 - DNA, 27 bp, Artificial Sequence
  Synthetic oligonucleotide
caatcttaaggcagggaaaaaaaaaaa

SEQ ID NO: 7116 - DNA, 27 bp, Artificial Sequence
  Synthetic oligonucleotide
aatcttaaggcagggaaaaaaaaaaaa

SEQ ID NO: 7117 - DNA, 27 bp, Artificial Sequence
  Synthetic oligonucleotide
atcttaaggcagggaaaaaaaaaaaaa

SEQ ID NO: 7118 - DNA, 27 bp, Artificial Sequence
  Synthetic oligonucleotide
tcttaaggcagggaaaaaaaaaaaaaa

SEQ ID NO: 7119 - DNA, 27 bp, Artificial Sequence
  Synthetic oligonucleotide
cttaaggcagggaaaaaaaaaaaaaaa

SEQ ID NO: 7120 - DNA, 27 bp, Artificial Sequence
  Synthetic oligonucleotide
ttaaggcagggaaaaaaaaaaaaaaaa

SEQ ID NO: 7121 - DNA, 27 bp, Artificial Sequence
  Synthetic oligonucleotide
taaggcagggaaaaaaaaaaaaaaaaa

SEQ ID NO: 7122 - DNA, 27 bp, Artificial Sequence
  Synthetic oligonucleotide
aaggcagggaaaaaaaaaaaaaaaaaa

SEQ ID NO: 7123 - RNA, 21 nt, Artificial Sequence
  Synthetic oligonucleotide
caauuuuaaagucuucugaug

SEQ ID NO: 7124 - RNA, 21 nt, Artificial Sequence
  Synthetic oligonucleotide
ucagaagacuuuaaaauugca

SEQ ID NO: 7125 - RNA, 27 nt, Artificial Sequence
  Synthetic oligonucleotide
ugcaauuuuaaagucuucugauguccc

SEQ ID NO: 7126 - RNA, 21 nt, Artificial Sequence
  Synthetic oligonucleotide
ugcaauuuuaaagucuucuac

SEQ ID NO: 7127 - DNA, 25 bp, Artificial Sequence
  Synthetic oligonucleotide
caauuuuaaagucuucuguugucat

SEQ ID NO: 7128 - DNA, 25 bp, Artificial Sequence
  Synthetic oligonucleotide
caauuuuaaagucuucugaagucat

SEQ ID NO: 7129 - DNA, 25 bp, Artificial Sequence
  Synthetic oligonucleotide
caauuuuaaagucuucugauaucat

SEQ ID NO: 7130 - DNA, 25 bp, Artificial Sequence
  Synthetic oligonucleotide
caauuuuaaagucuucugauggcat

SEQ ID NO: 7131 - DNA, 25 bp, Artificial Sequence
  Synthetic oligonucleotide
caauuuuaaagucuucugauguaat

SEQ ID NO: 7132 - DNA, 25 bp, Artificial Sequence
  Synthetic oligonucleotide
caauuuuaaagucuucugaugucgt

SEQ ID NO: 7133 - DNA, 25 bp, Artificial Sequence
  Synthetic oligonucleotide
caauuuuaaagucuucugaugucaa

SEQ ID NO: 7134 - RNA, 27 nt, Artificial Sequence
  Synthetic oligonucleotide
uugacaucagaagacuuuaaaauugca

SEQ ID NO: 7135 - RNA, 27 nt, Artificial Sequence
  Synthetic oligonucleotide
acgacaucagaagacuuuaaaauugca

SEQ ID NO: 7136 - RNA, 27 nt, Artificial Sequence
  Synthetic oligonucleotide
auuacaucagaagacuuuaaaauugca

SEQ ID NO: 7137 - RNA, 27 nt, Artificial Sequence
  Synthetic oligonucleotide
augccaucagaagacuuuaaaauugca

SEQ ID NO: 7138 - RNA, 27 nt, Artificial Sequence
  Synthetic oligonucleotide
augauaucagaagacuuuaaaauugca

SEQ ID NO: 7139 - RNA, 27 nt, Artificial Sequence
  Synthetic oligonucleotide
augacuucagaagacuuuaaaauugca

SEQ ID NO: 7140 - RNA, 27 nt, Artificial Sequence
  Synthetic oligonucleotide
augacaacagaagacuuuaaaauugca

SEQ ID NO: 7141 - DNA, 25 bp, Artificial Sequence
  Synthetic oligonucleotide
  misc_feature (19)..(25): n is a, c, g, t or u
guccuuuuuaucugaucunnnnnnn

SEQ ID NO: 7142 - RNA, 27 nt, Artificial Sequence
  Synthetic oligonucleotide
  misc_feature (1)..(7): n is a, c, g, or u
nnnnnnnagaucagauaaaaaggacaa

SEQ ID NO: 7143 - RNA, 27 nt, Artificial Sequence
  Synthetic oligonucleotide
  misc_feature (21)..(27): n is a, c, g, or u
uuguccuuuuuaucugaucunnnnnnn

SEQ ID NO: 7144 - RNA, 40 nt, Artificial Sequence
  Synthetic oligonucleotide
ugcauguuguccuuuuuaucugaucugugauuaaagcagu

SEQ ID NO: 7145 - DNA, 25 bp, Artificial Sequence
  Synthetic oligonucleotide
uuguugggguuggugcugauggcat

SEQ ID NO: 7146 - DNA, 25 bp, Artificial Sequence
  Synthetic oligonucleotide
uuguugggguuggugcuguaggcat

SEQ ID NO: 7147 - DNA, 25 bp, Artificial Sequence
  Synthetic oligonucleotide
uuguugggguuggugcuguuagcat

SEQ ID NO: 7148 - DNA, 25 bp, Artificial Sequence
  Synthetic oligonucleotide
uuguugggguuggugcuguugucat

SEQ ID NO: 7149 - DNA, 25 bp, Artificial Sequence
  Synthetic oligonucleotide
uuguugggguuggugcuguuggaat

SEQ ID NO: 7150 - DNA, 25 bp, Artificial Sequence
  Synthetic oligonucleotide
uuguugggguuggugcuguuggcgt

SEQ ID NO: 7151 - DNA, 25 bp, Artificial Sequence
  Synthetic oligonucleotide
uuguugggguuggugcuguuggcaa

SEQ ID NO: 7152 - RNA, 27 nt, Artificial Sequence
  Synthetic oligonucleotide
uugccaacagcaccaaccccaacaacu

SEQ ID NO: 7153 - RNA, 27 nt, Artificial Sequence
  Synthetic oligonucleotide
acgccaacagcaccaaccccaacaacu

SEQ ID NO: 7154 - RNA, 27 nt, Artificial Sequence
  Synthetic oligonucleotide
auuccaacagcaccaaccccaacaacu

SEQ ID NO: 7155 - RNA, 27 nt, Artificial Sequence
  Synthetic oligonucleotide
augacaacagcaccaaccccaacaacu

SEQ ID NO: 7156 - RNA, 27 nt, Artificial Sequence
  Synthetic oligonucleotide
augcuaacagcaccaaccccaacaacu

SEQ ID NO: 7157 - RNA, 27 nt, Artificial Sequence
  Synthetic oligonucleotide
augccuacagcaccaaccccaacaacu

SEQ ID NO: 7158 - RNA, 27 nt, Artificial Sequence
  Synthetic oligonucleotide
augccaucagcaccaaccccaacaacu

SEQ ID NO: 7159 - DNA, 25 bp, Artificial Sequence
  Synthetic oligonucleotide
gccaucaguaucuuaauguaggact

SEQ ID NO: 7160 - DNA, 25 bp, Artificial Sequence
  Synthetic oligonucleotide
gccaucaguaucuuaaugauggact

SEQ ID NO: 7161 - DNA, 25 bp, Artificial Sequence
  Synthetic oligonucleotide
gccaucaguaucuuaaugaaagact

SEQ ID NO: 7162 - DNA, 25 bp, Artificial Sequence
  Synthetic oligonucleotide
gccaucaguaucuuaaugaaguact

SEQ ID NO: 7163 - DNA, 25 bp, Artificial Sequence
  Synthetic oligonucleotide
gccaucaguaucuuaaugaagguct

SEQ ID NO: 7164 - DNA, 25 bp, Artificial Sequence
  Synthetic oligonucleotide
gccaucaguaucuuaaugaaggatt

SEQ ID NO: 7165 - DNA, 25 bp, Artificial Sequence
  Synthetic oligonucleotide
gccaucaguaucuuaaugaaggaca

SEQ ID NO: 7166 - RNA, 27 nt, Artificial Sequence
  Synthetic oligonucleotide
uguccuucauuaagauacugauggcac

SEQ ID NO: 7167 - RNA, 27 nt, Artificial Sequence
  Synthetic oligonucleotide
aauccuucauuaagauacugauggcac

SEQ ID NO: 7168 - RNA, 27 nt, Artificial Sequence
  Synthetic oligonucleotide
agaccuucauuaagauacugauggcac

SEQ ID NO: 7169 - RNA, 27 nt, Artificial Sequence
  Synthetic oligonucleotide
aguacuucauuaagauacugauggcac

SEQ ID NO: 7170 - RNA, 27 nt, Artificial Sequence
  Synthetic oligonucleotide
agucuuucauuaagauacugauggcac

SEQ ID NO: 7171 - RNA, 27 nt, Artificial Sequence
  Synthetic oligonucleotide
aguccaucauuaagauacugauggcac

SEQ ID NO: 7172 - RNA, 27 nt, Artificial Sequence
  Synthetic oligonucleotide
aguccuacauuaagauacugauggcac

SEQ ID NO: 7173 - DNA, 25 bp, Artificial Sequence
  Synthetic oligonucleotide
uugaccuacguggcuugguagauaa

SEQ ID NO: 7174 - DNA, 25 bp, Artificial Sequence
  Synthetic oligonucleotide
uugaccuacguggcuuggaugauaa

SEQ ID NO: 7175 - DNA, 25 bp, Artificial Sequence
  Synthetic oligonucleotide
uugaccuacguggcuuggaaaauaa

SEQ ID NO: 7176 - DNA, 25 bp, Artificial Sequence
  Synthetic oligonucleotide
uugaccuacguggcuuggaagguaa

SEQ ID NO: 7177 - DNA, 25 bp, Artificial Sequence
  Synthetic oligonucleotide
uugaccuacguggcuuggaagaaaa

SEQ ID NO: 7178 - DNA, 25 bp, Artificial Sequence
  Synthetic oligonucleotide
uugaccuacguggcuuggaagauga

SEQ ID NO: 7179 - DNA, 25 bp, Artificial Sequence
  Synthetic oligonucleotide
uugaccuacguggcuuggaagauat

SEQ ID NO: 7180 - RNA, 27 nt, Artificial Sequence
  Synthetic oligonucleotide
auaucuuccaagccacguaggucaaga

SEQ ID NO: 7181 - RNA, 27 nt, Artificial Sequence
  Synthetic oligonucleotide
ucaucuuccaagccacguaggucaaga

SEQ ID NO: 7182 - RNA, 27 nt, Artificial Sequence
  Synthetic oligonucleotide
uuuucuuccaagccacguaggucaaga

SEQ ID NO: 7183 - RNA, 27 nt, Artificial Sequence
  Synthetic oligonucleotide
uuaccuuccaagccacguaggucaaga

SEQ ID NO: 7184 - RNA, 27 nt, Artificial Sequence
  Synthetic oligonucleotide
uuauuuuccaagccacguaggucaaga

SEQ ID NO: 7185 - RNA, 27 nt, Artificial Sequence
  Synthetic oligonucleotide
uuaucauccaagccacguaggucaaga

SEQ ID NO: 7186 - RNA, 27 nt, Artificial Sequence
  Synthetic oligonucleotide
uuaucuaccaagccacguaggucaaga

SEQ ID NO: 7187 - RNA, 36 nt, Artificial Sequence
  Synthetic oligonucleotide
  misc_feature (1)..(20): n is a, c, g, or u
nnnnnnnnnnnnnnnnnnnngcagccgaaaggcugc

SEQ ID NO: 7188 - RNA, 22 nt, Artificial Sequence
  Synthetic oligonucleotide
  misc_feature (1)..(22): n is a, c, g, or u
nnnnnnnnnnnnnnnnnnnnnn

SEQ ID NO: 7189 - DNA, 22 bp, Artificial Sequence
  Synthetic oligonucleotide
  misc_feature (1)..(22): n is a, c, g, t or u
nnnnnnnnnnnnnnnnnnnnnn

SEQ ID NO: 7190 - RNA, 36 nt, Artificial Sequence
  Synthetic oligonucleotide
uugaccuacguggcuuggaagcagccgaaaggcugc

SEQ ID NO: 7191 - RNA, 22 nt, Artificial Sequence
  Synthetic oligonucleotide
uuccaagccacguaggucaaga

SEQ ID NO: 7192 - RNA, 36 nt, Artificial Sequence
  Synthetic oligonucleotide
auguuguccuuuuuaucugagcagccgaaaggcugc

SEQ ID NO: 7193 - RNA, 22 nt, Artificial Sequence
  Synthetic oligonucleotide
ucagauaaaaaggacaacaugc

SEQ ID NO: 7194 - DNA, 27 bp, Artificial Sequence
  Synthetic oligonucleotide
  misc_feature (1)..(27): n is a, c, g, t or u
nnnnnnnnnnnnnnnnnnnnnnnnnnn

SEQ ID NO: 7195 - RNA, 29 nt, Artificial Sequence
  Synthetic oligonucleotide
  misc_feature (1)..(29): n is a, c, g, or u
nnnnnnnnnnnnnnnnnnnnnnnnnnnnn

SEQ ID NO: 7196 - RNA, 36 nt, Artificial Sequence
  Synthetic oligonucleotide
agaauaagauuacaguuguugcagccgaaaggcugc

SEQ ID NO: 7197 - RNA, 22 nt, Artificial Sequence
  Synthetic oligonucleotide
aacaacuguaaucuuauucugg

SEQ ID NO: 7198 - RNA, 36 nt, Artificial Sequence
  Synthetic oligonucleotide
aagauuacaguuguuggggugcagccgaaaggcugc

SEQ ID NO: 7199 - RNA, 22 nt, Artificial Sequence
  Synthetic oligonucleotide
accccaacaacuguaaucuuau

SEQ ID NO: 7200 - RNA, 36 nt, Artificial Sequence
  Synthetic oligonucleotide
agauuacaguuguugggguugcagccgaaaggcugc

SEQ ID NO: 7201 - RNA, 22 nt, Artificial Sequence
  Synthetic oligonucleotide
aaccccaacaacuguaaucuua

SEQ ID NO: 7202 - RNA, 36 nt, Artificial Sequence
  Synthetic oligonucleotide
caguuguugggguuggugcugcagccgaaaggcugc

SEQ ID NO: 7203 - RNA, 22 nt, Artificial Sequence
  Synthetic oligonucleotide
agcaccaaccccaacaacugua

SEQ ID NO: 7204 - RNA, 36 nt, Artificial Sequence
  Synthetic oligonucleotide
uuguugggguuggugcuguugcagccgaaaggcugc

SEQ ID NO: 7205 - RNA, 22 nt, Artificial Sequence
  Synthetic oligonucleotide
aacagcaccaaccccaacaacu

SEQ ID NO: 7206 - RNA, 36 nt, Artificial Sequence
  Synthetic oligonucleotide
ugugccaucaguaucuuaaugcagccgaaaggcugc

SEQ ID NO: 7207 - RNA, 22 nt, Artificial Sequence
  Synthetic oligonucleotide
auuaagauacugauggcacagg

SEQ ID NO: 7208 - RNA, 36 nt, Artificial Sequence
  Synthetic oligonucleotide
gccaucaguaucuuaaugaagcagccgaaaggcugc

SEQ ID NO: 7209 - RNA, 22 nt, Artificial Sequence
  Synthetic oligonucleotide
uucauuaagauacugauggcac

SEQ ID NO: 7210 - RNA, 36 nt, Artificial Sequence
  Synthetic oligonucleotide
uaucuugaccuacguggcuugcagccgaaaggcugc

SEQ ID NO: 7211 - RNA, 22 nt, Artificial Sequence
  Synthetic oligonucleotide
aagccacguaggucaagauauc

SEQ ID NO: 7212 - RNA, 36 nt, Artificial Sequence
  Synthetic oligonucleotide
cuguauggaguggaaugaaugcagccgaaaggcugc

SEQ ID NO: 7213 - RNA, 22 nt, Artificial Sequence
  Synthetic oligonucleotide
auucauuccacuccauacaggc

SEQ ID NO: 7214 - RNA, 36 nt, Artificial sequence
  Synthetic oligonucleotide
auaucuugaccuacguggcugcagccgaaaggcugc

SEQ ID NO: 7215 - RNA, 22 nt, Artificial sequence
  Synthetic oligonucleotide
agccacguaggucaagauaucc

We claim:

1. A double stranded nucleic acid (dsNA) comprising a sense strand and an antisense strand, wherein the antisense strand is 19-35 nucleotides in length, wherein the antisense strand is complementary to a target lactate dehydrogenase mRNA sequence as set forth in SEQ ID NO: 401 along at least 19 nucleotides of said antisense strand length, and wherein the dsNA comprises one or more modified nucleotides.

2. The dsNA of claim 1, wherein the sense strand and antisense strand form a duplex such that the antisense strand comprises a two nucleotide overhang at its 3' end.

3. The dsNA of claim 1, wherein the dsNA comprises a duplex of 19 to 25 base pairs in length.

4. The dsNA of claim 2, wherein the sense strand is 25 to 53 nucleotides in length.

5. The dsNA of claim 2, wherein the sense strand is 36 nucleotides in length and/or wherein the antisense strand is 22 nucleotides in length.

6. The dsNA of claim 1, wherein the sense strand and the antisense strand are each in the range of 21 to 23 nucleotides in length.

7. The dsNA of claim 1, wherein the sense strand is 21 nucleotides in length and the antisense strand is 23 nucleotides in length.

8. The dsNA of claim 7, wherein the 3' terminus of the sense strand and the 5' terminus of the antisense strand form a blunt end.

9. The dsNA of claim 1, wherein the sense strand comprises a tetraloop at its 3' end.

10. The dsNA of claim 6, wherein the sense strand comprises a tetraloop at its 3' end.

11. The dsNA of claim 9, wherein the tetraloop comprises a single stranded loop having a sequence of GAAA.

12. The dsNA of claim 1, wherein the dsNA comprises at least one phosphorothioate linkage.

13. The dsNA of claim 11, wherein the dsNA comprises at least one phosphorothioate linkage.

14. The dsNA of claim 1, wherein the one or more modified nucleotides contains a 2' modification.

15. The dsNA of claim 14, wherein the one or more modified nucleotides are selected from a 2'-O-methyl nucleotide and a 2'-fluoro nucleotide.

16. The dsNA of claim 15, wherein the dsNA comprises at least one 2'-fluoro nucleotide and at least one 2'-O-methyl nucleotide.

17. The dsNA of claim 1, wherein the dsNA is attached to a moiety selected from the group consisting of a GalNAc moiety, a cholesterol moiety, and a cholesterol targeting ligand.

18. The dsNA of claim 15, wherein the dsNA is attached to a GalNAc moiety.

19. A pharmaceutical composition comprising the dsNA of claim 18 and a pharmaceutically acceptable carrier.

20. A nucleic acid comprising an oligonucleotide strand of 19-35 nucleotides in length, wherein said oligonucleotide strand is complementary to a target lactate dehydrogenase mRNA sequence as set forth in SEQ ID NO: 401 along at least 19 nucleotides of said oligonucleotide strand length, and wherein the nucleic acid comprises one or more modified nucleotides.

21. A mammalian cell containing the nucleic acid of claim 20.

22. A pharmaceutical composition comprising the nucleic acid of claim 20 and a pharmaceutically acceptable carrier.

23. A double stranded nucleic acid (dsNA) comprising a sense strand and an antisense strand, wherein the antisense strand is 19-35 nucleotides in length, wherein the antisense strand is complementary to a target lactate dehydrogenase mRNA sequence as set forth in SEQ ID NO: 401 along at least 19 nucleotides of said antisense strand length, wherein the complementary region of the antisense strand contains between one and four mismatched nucleotide residues relative to SEQ ID NO: 401, and wherein the dsNA comprises one or more modified nucleotides.

24. The dsNA of claim 23, wherein the complementary region of the antisense strand contains three, two, or one mismatched nucleotide residues relative to SEQ ID NO: 401.

25. The dsNA of claim 23, wherein the sense strand and antisense strand form a duplex such that the antisense strand comprises a two nucleotide overhang at its 3' end.

26. The dsNA of claim 23, wherein the dsNA comprises a duplex of 19 to 25 base pairs in length.

27. The dsNA of claim 25, wherein the sense strand is 25 to 53 nucleotides in length.

28. The dsNA of claim 25, wherein the sense strand is 36 nucleotides in length and/or wherein the antisense strand is 22 nucleotides in length.

29. The dsNA of claim 23, wherein the sense strand and the antisense strand are each in the range of 21 to 23 nucleotides in length.

30. The dsNA of claim 23, wherein the sense strand is 21 nucleotides in length and the antisense strand is 23 nucleotides in length.

31. The dsNA of claim 30, wherein the 3' terminus of the sense strand and the 5' terminus of the antisense strand form a blunt end.

32. The dsNA of claim 23, wherein the sense strand comprises a tetraloop at its 3' end.

33. The dsNA of claim 29, wherein the sense strand comprises a tetraloop at its 3' end.

34. The dsNA of claim 32, wherein the tetraloop comprises a single stranded loop having a sequence of GAAA.

* * * * *